US012630821B2

(12) United States Patent
Grunewald et al.

(10) Patent No.: US 12,630,821 B2
(45) Date of Patent: May 19, 2026

(54) SELECTIVE CURBING OF UNWANTED RNA EDITING (SECURE) DNA BASE EDITOR VARIANTS

(71) Applicant: The General Hospital Corporation, Boston, MA (US)

(72) Inventors: Julian Grunewald, Charlestown, MA (US); J. Keith Joung, Winchester, MA (US); Ronghao Zhou, Charlestown, MA (US)

(73) Assignee: The General Hospital Corporation, Boston, MA (US)

( * ) Notice: Subject to any disclaimer, the term of this patent is extended or adjusted under 35 U.S.C. 154(b) by 763 days.

(21) Appl. No.: 17/284,043

(22) PCT Filed: Oct. 10, 2019

(86) PCT No.: PCT/US2019/055705
§ 371 (c)(1),
(2) Date: Apr. 9, 2021

(87) PCT Pub. No.: WO2020/077138
PCT Pub. Date: Apr. 16, 2020

(65) Prior Publication Data
US 2021/0395730 A1      Dec. 23, 2021

Related U.S. Application Data

(60) Provisional application No. 62/744,026, filed on Oct. 10, 2018.

(51) Int. Cl.
*A61K 38/00* (2006.01)
*C12N 9/22* (2006.01)
*C12N 9/78* (2006.01)
*C12N 15/10* (2006.01)
*C12N 15/11* (2006.01)

(52) U.S. Cl.
CPC .............. *C12N 15/111* (2013.01); *C12N 9/22* (2013.01); *C12N 9/78* (2013.01); *C12N 15/102* (2013.01); *C12N 2310/20* (2017.05); *C12Y 305/04001* (2013.01)

(58) Field of Classification Search
CPC .......... C12N 15/111; C12N 9/22; C12N 9/78; C12N 15/102; C12N 2310/20; C12Y 305/04001
See application file for complete search history.

(56) References Cited

U.S. PATENT DOCUMENTS

| | | |
|---|---|---|
| 11,732,274 B2 | 8/2023 | Liu et al. |
| 2007/0016974 A1 | 1/2007 | Byrum et al. |
| 2020/0140842 A1 | 5/2020 | Joung et al. |
| 2020/0172885 A1 | 6/2020 | Joung et al. |
| 2020/0172895 A1 | 6/2020 | Joung et al. |
| 2020/0308571 A1 | 10/2020 | Joung et al. |
| 2022/0290121 A1 | 9/2022 | Joung et al. |

FOREIGN PATENT DOCUMENTS

| | | | |
|---|---|---|---|
| CN | 105745221 | 7/2016 | |
| WO | WO 2008/027899 | 3/2008 | |
| WO | WO 2010/132092 | 11/2010 | |
| WO | WO 2016/103233 | 6/2016 | |
| WO | WO 2016/141224 | 9/2016 | |
| WO | WO 2016/183438 | 11/2016 | |
| WO | WO 2017/040348 | 3/2017 | |
| WO | WO 2018/176009 | 9/2018 | |
| WO | WO-2018176009 A1 * | 9/2018 | .......... C12N 15/102 |
| WO | WO 2021/042047 | 3/2021 | |
| WO | WO 2021/113611 | 6/2021 | |

OTHER PUBLICATIONS

Gupta et al., "Expanding the genetic editing tool kit: ZFNs, TALENs, and CRISPR-Cas9" 2014. J Clin Invest. 124(10): 4154-4161 (Year: 2014).*
Chen et al., "Hypermutation induced by APOBEC-1 overexpression can be eliminated" RNA (2010), 16: 1040-1052 (Year: 2010).*
MacGinnitie et al., "Mutagenesis of apobec-1, the Catalytic Subunit of the Mammalian Apolipoprotein B mRNA Editing Enzyme, Reveals Distinct Domains That Mediate Cytosine Nucleoside Deaminase, RNA Binding, and RNA Editing Activity" J of Bio Chem (1995), 270(24): 14768-14775 (Year: 1995).*
Ma et al., "AID-mediated in situ target mutations: a new technology for mammalian DNA base editing," Chinese Journal of Cell Biology, 2017, 39(3):255-260, 8 pages (with English abstract).
Blanc et al., "Genome-wide identification and functional analysis of Apobec-1-mediated C-to-U RNA editing in mouse small intestine and liver," Genome Biol., 2014, 15:R79, 17 pages.
Chadwick et al., "Reduced Blood Lipid Levels With In Vivo CRISPR-Cas9 Base Editing of ANGPTL3," Circulation, 2018, 137:975-977.
Chen et al., "Apolipoprotein B-48 is the product of a messenger RNA with an organ-specific in-frame stop codon," Science, 1987, 238:363-366.
Chen et al., "Hypermutation induced by APOBEC-1 overexpression can be eliminated," RNA, May 2010, 16(5):1040-1052.
Chester et al., "The apolipoprotein B mRNA editing complex performs a multifunctional cycle and suppresses nonsense-mediated decay," EMBO J. Aug. 2003, (15):3971-3982.
Gehrke et al., "An APOBEC3A-Cas9 base editor with minimized bystander and off-target activities," Nat. Biotechnol., 2018, 36(10):977-982.
Harris et al., "RNA Editing Enzyme APOBECI and Some of Its Homologs Can Act as DNA Mutators," Molecular Cell, Nov. 2002, 10(5):1247-1253.
Hess et al., "Directed Evolution Using DCas9-targeted Somatic Hypermutation in Mammalian Cells," Nat Methods, Dec. 2016, 13(12):1036-1042.

(Continued)

*Primary Examiner* — Evelyn Y Pyla
*Assistant Examiner* — Katherine R Small
(74) *Attorney, Agent, or Firm* — Fish & Richardson P.C.

(57) ABSTRACT

Engineered base editor variants with reduced RNA editing activity, and methods of using the same.

10 Claims, 25 Drawing Sheets

Specification includes a Sequence Listing.

(56) References Cited

OTHER PUBLICATIONS

Jiang et al., "BE-PLUS: a new base editing tool with broadened editing window and enhanced fidelity," Cell Res., Aug. 2018, 28(8):855-861, 7 pages.

Koblan et al., "Improving cytidine and adenine base editors by expression optimization and ancestral reconstruction," Nat Biotechnol., Oct. 2018, 36(9):843-846.

Komor et al., "CRISPR-Based Technologies for the Manipulation of Eukaryotic Genomes," Cell, 2017, 168:20-36.

Komor et al., "Improved base excision repair inhibition and bacteriophage Mu Gam protein yields C : G-to-T : A base editors with higher efficiency and product purity," Sci. Adv., Aug. 2017, 3(8):eaao4774, 9 pages.

Komor et al., "Programmable editing of a target base in genomic DNA without double-stranded DNA cleavage," Nature, 2016, 533(7603):420-424.

MacGinnitie et al., "Mutagenesis of apobec-1, the Catalytic Subunit of the Mammalian Apolipoprotein B mRNA Editing Enzyme, Reveals Distinct Domains That Mediate Cytosine Nucleoside Deaminase, RNA Binding, and RNA Editing Activity," J. Biol. Chem., Jun. 1995, 270(24):14768-14775.

Michnick et al., Chapter 25: Protein-Fragment Complementation Assays for Large-Scale Analysis, Functional Dissection and Dynamic Studies of Protein-Protein Interactions in Living Cells, Signal Transduction Protocols, Methods in Molecular Biology, Jul. 2011, 395-425.

Navaratnam et al., "Evolutionary origins of apoB mRNA editing: Catalysis by a cytidine deaminase that has acquired a novel RNA-binding motif at its active site," Cell, Apr. 1995, 81(2):187-195.

Nishida et al., "Targeted Nucleotide Editing Using Hybrid Prokaryotic and Vertebrate Adaptive Immune Systems," Science, Sep. 2016, 353(6305):aaf8729.

PCT International Preliminary Report on Patentability in International Appln. No. PCT/US2019/055705, dated Apr. 22, 2021, 12 pages.

PCT International Search Report and Written Opinion in International Appln. No. PCT/US2019/055705, dated Apr. 1, 2020, 17 pages.

Rees et al., "Improving the DNA specificity and applicability of base editing through protein engineering and protein delivery," Nat Commun., Jun. 2017, 8(1):1-10.

Rosenberg et al., "Transcriptome-wide sequencing reveals numerous APOBEC1 mRNA-editing targets in transcript 3' UTRs," Nat Struct Mol Biol., 2011, 18:230-236.

Salter et al., "The APOBEC Protein Family: United by Structure, Divergent in Function," Trends Biochem Sci., Jul. 2016, 41(7):578-594.

Shimatani et al., "Targeted base editing in rice and tomato using a CRISPR-Cas9 cytidine deaminase fusion," Nat Biotechnol., 2017, 35:441-443.

Skuse et al., "The neurofibromatosis type I messenger RNA undergoes base-modification RNA editing," Nucleic Acids Res., 1996, 24:478-485.

Sowden et al., "Overexpression of APOBEC-1 results in mooring sequence-dependent promiscuous RNA editing," J Biol Chem., 1996, 271:3011-3017.

Teng et al., "Molecular cloning of an apolipoprotein B messenger RNA editing protein," Science, 1993, 260:1816-1819.

Teng et al., "Mutational Analysis of Apolipoprotein B mRNA Editing Enzyme (APOBEC1). Structure-Function Relationships of RNA Editing and Dimerization," J. Lipid Res., Apr. 1999, 40(4):623-635.

Thuronyi et al., "Continuous evolution of base editors with expanded target compatibility and improved activity," Nat Biotechnol., 2019, 37:1070-1079.

Wang et al., "Efficient base editing in methylated regions with a human APOBEC3A-Cas9 fusion," Nat. Biotechnol., Aug. 2018, 36(10):946-949.

Yamanaka et al., "A novel translational repressor mRNA is edited extensively in livers containing tumors caused by the transgene expression of the apoB mRNA-editing enzyme," Genes Dev., 1997, 11:321-333.

Yamanaka et al., "Cloning and mutagenesis of the rabbit ApoB mRNA editing protein. A zinc motif is essential for catalytic activity, and noncatalytic auxiliary factor(s) of the editing complex are widely distributed," J Biol Chem., Aug. 1994, 269(34):21725-21734.

Yamanaka et al., "Hyperediting of multiple cytidines of apolipoprotein B mRNA by APOBEC-1 requires auxiliary protein(s) but not a mooring sequence motif," J Biol Chem., 1996, 271:11506-11510.

Yeh et al., "In vivo base editing of post-mitotic sensory cells," Nat Commun., 2018, 9:2184, 10 pages.

Zafra et al., "Optimized base editors enable efficient editing in cells, organoids and mice," Nat Biotechnol., 2018, 36:888-893.

Zhang et al., "Programmable base editing of zebrafish genome using a modified CRISPR-Cas9 system, " Nat Commun., 2017, 8:118, 5 pages.

Zong et al., "Precise base editing in rice, wheat and maize with a Cas9-cytidine deaminase fusion," Nat Biotechnol., 2017, 35:438-440.

Siloto et al., "Site Saturation Mutagenesis: Methods and Applications in Protein Engineering," Biocatalysis and Agricultural Biotechnology, Jul. 2012, 1(3):181-189.

Gajula, "Designing an Elusive C•G→G•C CRISPR Base Editor," Trends Biochem Sci., Feb. 2019, 44(2):91-94.

Molla et al., "Base Editing Landscape Extends to Perform Transversion Mutation," Trends Genet., Dec. 2020, 36(12):899-901.

Zhao et al., "Glycosylase base editors enable C-to-A and C-to-G base changes," Nat Biotechnol., Jan. 2021, 39(1):35-40, 11 pages.

Singh et al., "Protein Engineering Approaches in the Post-Genomic Era," Curr. Protein Pept. Sci., 2017, 18:1-11.

Stier et al., "Cytosine-to-uracil deamination by SssI DNA methyltransferase," PLoS ONE, Oct. 2013, 8(10):e79003, 10 pages.

Ma et al., "Integration and exchange of split dCas9 domains for transcriptional controls in mammalian cells," Nat. Comm., Oct. 2016, 7:13056, 7 pages.

Shivarov et al., "Dissociation of in vitro DNA deamination activity and physiological functions of AID mutants," Proc. Natl. Acad. Sci. USA, Oct. 2008, 105(41):15866-15871.

Fan et al., "Cytosine and adenine deaminase base-editors induce broad and nonspecific changes in gene expression and splicing," Communications Biology, 2021, 4:882, 12 pages.

Mali et al., "CAS9 transcriptional activators for target specificity screening and paired nickases for cooperative genome engineering," Nat. Biotechnol., Sep. 2013, 31(9):833-838, 8 pages.

Giglione et al., "Protein N-terminal methionine excision," Cell Mol Life Sci., Jun. 2004, 61(12):1455-74.

* cited by examiner rAPOBEC1 is known to edit both ssDNA & ssRNA

Do DNA Cytidine Base Editors also edit ssRNA?

*APOB transcript*

C to U (shown as T) conversion percent

HEK293 cells
gRNA: RNF2, site 1
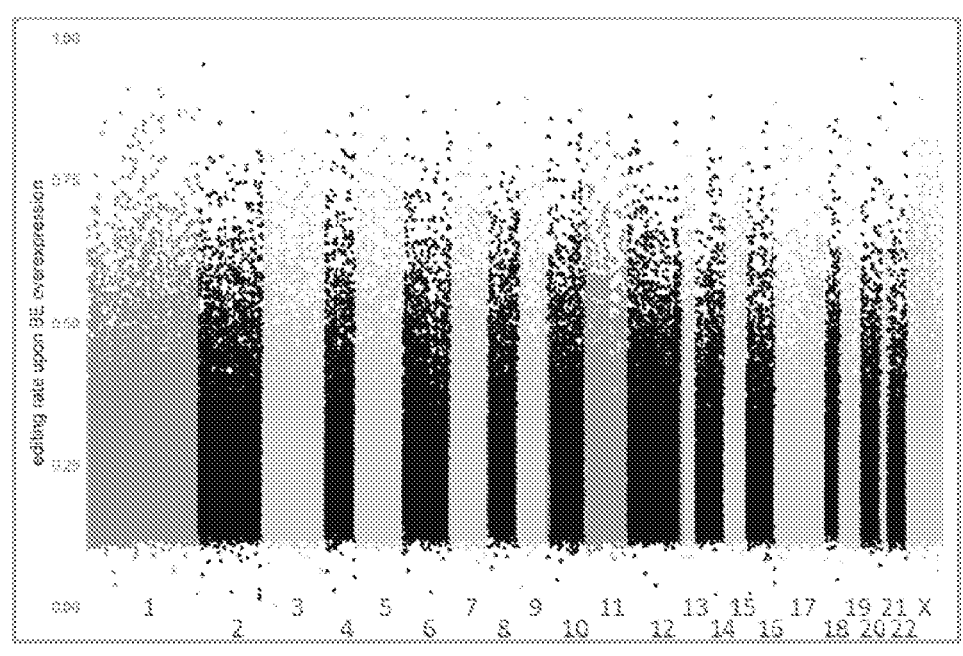
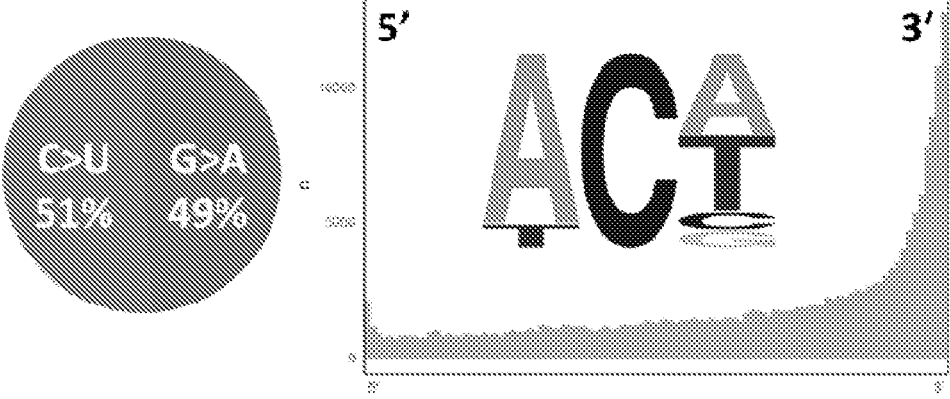
*FIG. 4A*

HepG2 cells
gRNA: RNF2, site 1
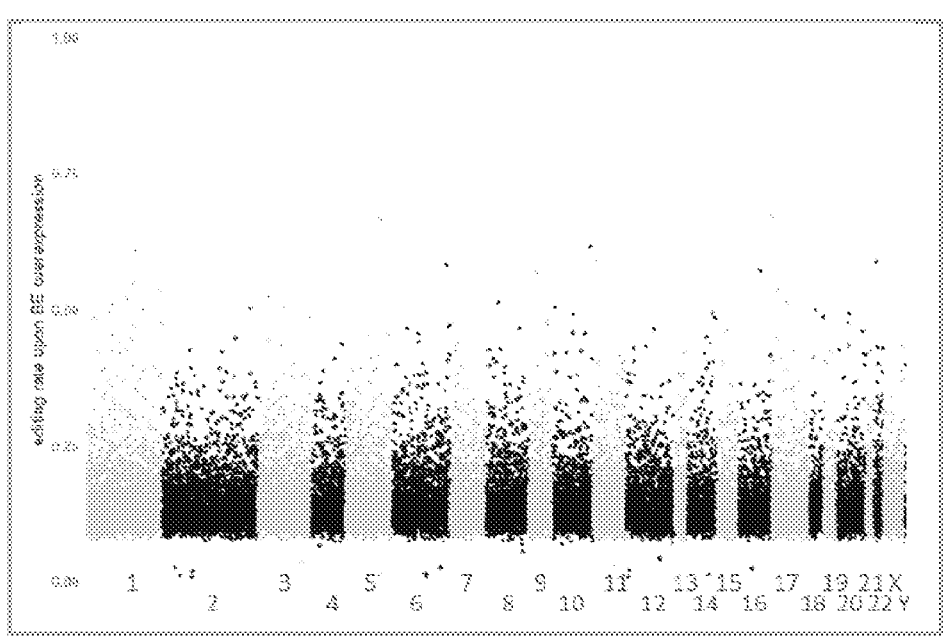
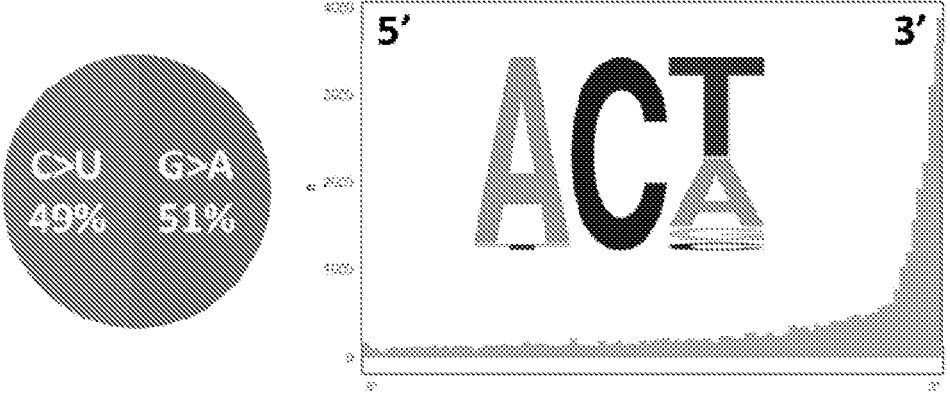
*FIG. 4B*

HEK293 cells
gRNA: EMX1, site 1
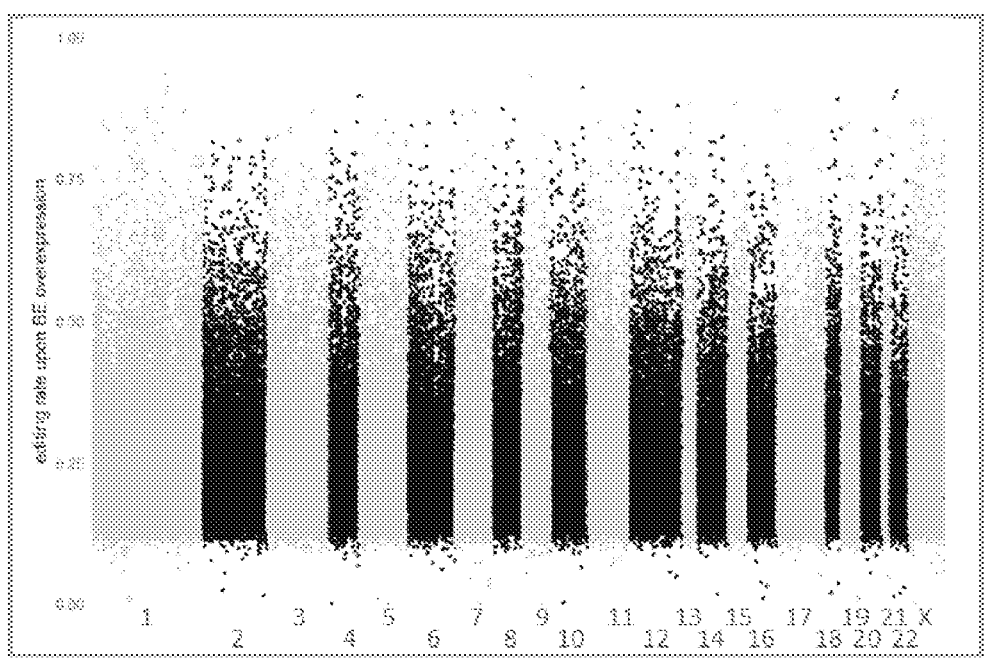
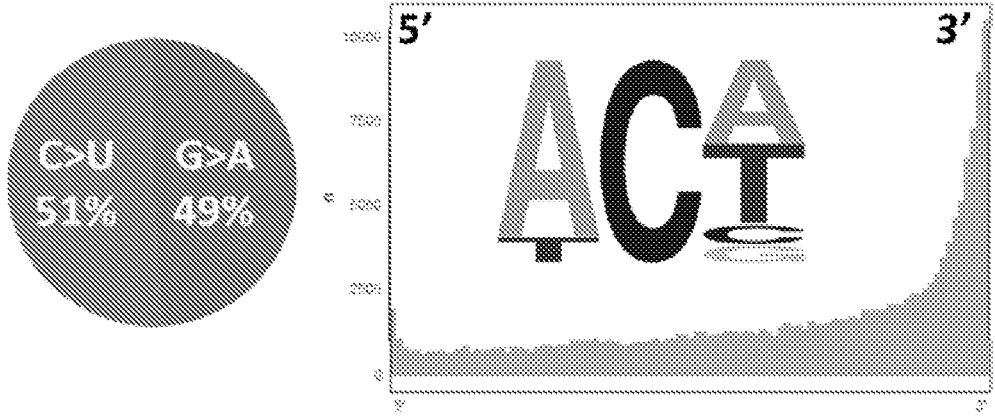
*FIG. 5A*

HEK293 cells
gRNA: non-targeting to human genome
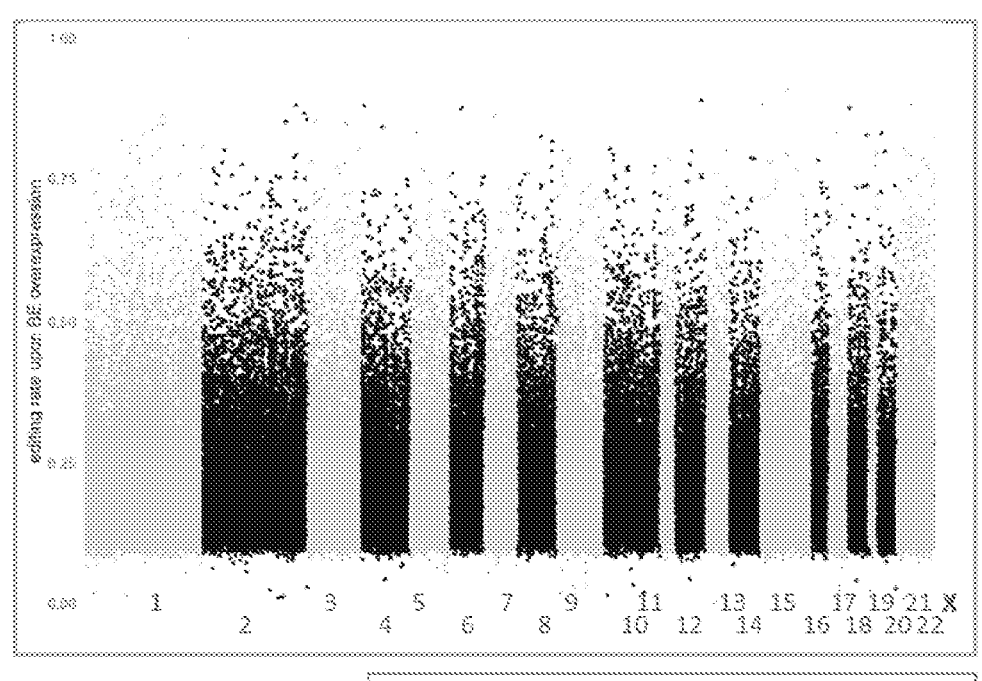
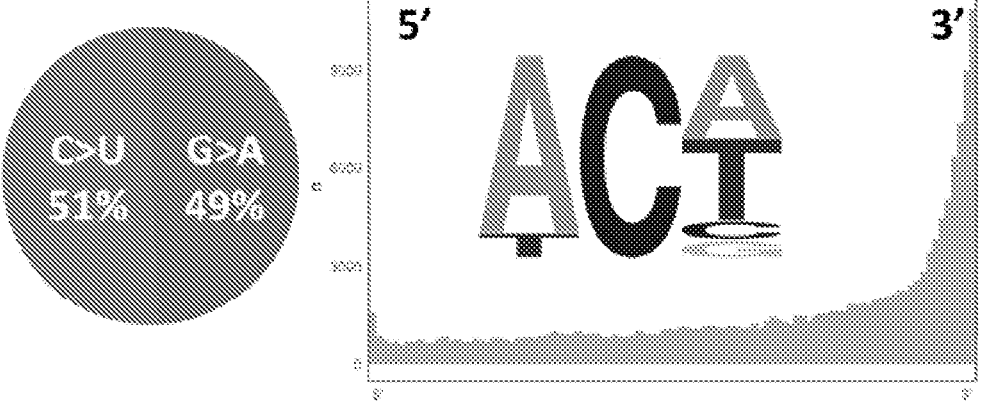
*FIG. 5B*

*FIG. 13B*

```
NP_037039     1  MSSETGPVAVDPTLRRRIEPHEFEVFFDPRELRKETCLLYEINWGGRHSIWRHTSQNTNKHVEVNFIEKFTTERYFCPNT  80
NP_112436     1  MSSETGPVAVDPTLRRRIEPHEFEVFFDPRELRKETCLLYEINWGGRHSVWRHTSQNTSNHVEVNFLEKFTTERYFRPNT  80
XP_001164661  1  MTSEKGPSTGDPTLRRRIEPWEFDVFYDPRELRKEACLLYEIKWGMSRKIWRSSGKNTTNHVEVNFIKKFTSERHFHPSI  80
XP_543826     1  MASDKGPSAGDATLRRRIEPWEFEGEFDPRELRKETCLLYEIQWGTSHKTWRNSGKNTTNHVEINFMEKFAAERQYCPSI  80
NP_001635     1  MTSEKGPSTGDPTLRRRIEPWEFDVFYDPRELRKEACLLYEIKWGMSRKIWRSSGKNTTNHVEVNFIKKFTSERDFHPSM  80
XP_002687863  1  MASDRGPPAGDPTLRRRIEPWEFEFSFDPRKFCKEACLLYEIQWGNNRDVWRHSGKNTTKHVERNFIEKIASERYFCPSI  80
XP_001112583  1  MTSEKGPSTGDPTLRRRIEPWEFDIFYDPRELRKEACLLYEIKWGMSPKIWRSSGKNTTNHVEVNFIEKLTSERRFHSSI  80

NP_037039    81  RCSITWFLSWSPCGECSRAITEFLSRYPHVTLFIYIARLYHHADPRNRQGLRDLISSGVTIQIMTEQESGYCWRNFVNYS  160
NP_112436    81  RCSITWFLSWSPCGECSRAITEFLSRHPYVTLFIYIARLYHHTDQRNRQGLRDLISSGVTIQIMTEQEYCYCWRNFVNYP  160
XP_001164661 81  SCSITWFLSWSPCWECSQAIREFLSQHPGVTLVIYVARLFWHMDQQNRQGLRDLVNSGVTIQIMRASEYYHCWRNFVNYP  160
XP_543826    81  RCSITWFLSWSPCWECSNAIRGFLSQHPSVTLVIYVARLFWHTDPQNRQGLRDLINSGVTIQIMTVPEYDHCWRNFVNYP  160
NP_001635    81  SCSITWFLSWSPCWECSQAIREFLSRHPGVTLVIYVARLFWHMDQQNRQGLRDLVNSGVTIQIMRASEYYHCWRNFVNYP  160
XP_002687863 81  RCFIFWYLSWSPCWECSKAIREFLNQHPNVTLVIYIARLFQHMDPQNRQGLKDLVQSGVTIQVMRAPEYEYCWRNFVNYP  160
XP_001112583 81  SCSITWFLSWSPCWECSQAIREFLSQHPGVTLVIYVARLFWHTDQQNRQGLRDLVNSGVTIQIMRASEYYHCWRNFVNYP  160

NP_037039   161  PSNEAHWPRYPHLWVRLYVLELYCIILGLPPCLNILRRKQPQLTFFTIALQSCHYQRLPPHILWATGLK------  229
NP_112436   161  PSNEAYWPRYPHLWVKLYVLELYCIILGLPPCLKILRRKQPQLTFFTITLQTCHYQRIPPHLLWATGLK------  229
XP_001164661 161 PGDEAHWPQYPPLWMMLYALELHCIILSLPPCLKISRRWQNHLTFFSLHLQNCHYQTIPPHILLATGLIHPSVAWR  236
XP_543826   161  PGKEDHWPRYPVLWMKIYALELHCIILNLPPCLKISRRNQHLTFFRLTLQDCHYQTIPPPILLDMGLIQPLVTWR  236
NP_001635   161  PGDEAHWPQYPPLWMMLYALELHCIILSLPPCLKISRRWQNHLTFFRLHLQNCHYQTIPPHILLATGLIHPSVAWR  236
XP_002687863 161 RGKEAHWPRYPLWMNLYALELYCIILGLPPCLHISRRYQNQLIVFRLTLQNCHYQMIPPYILLATGMVQLPMTWR  236
XP_001112583 161 PGEEAHWPRYPLWMMLYALELHCIILSLPPCLKISRRWQNHLTFFRLHLQNCHYQMIPPHILLATGLIQPSVTWR  236
```

FIG. 15

SELECTIVE CURBING OF UNWANTED RNA EDITING (SECURE) DNA BASE EDITOR VARIANTS

CLAIM OF PRIORITY

This application is the U.S. National Stage of PCT International Patent Application No. PCT/US2019/055705, filed on Oct. 10, 2019, which claims the benefit of U.S. Provisional Patent Application Ser. No. 62/744,026, filed on Oct. 10, 2018. The entire contents of the foregoing are hereby incorporated by reference.

STATEMENT OF FEDERALLY SPONSORED RESEARCH

This invention was made with government support under Grant No. HR0011-17-2-0042 awarded by the Defense Advanced Research Projects Agency, and Grant Nos. HG009490, and GM118158 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Nov. 26, 2019, is named 29539-0359WO1_SL.txt and is 789,207 bytes in size.

TECHNICAL FIELD

Described herein are engineered base editor variants that have reduced or negligible RNA editing activity, and methods of using the same.

BACKGROUND

Engineered base editors have recently emerged as a powerful technology for efficiently introducing single base changes in DNA[1]. Cytosine base editors (CBEs) are fusion proteins that induce targeted cytosine (C) to uracil (U) alterations in single-stranded DNA by using catalytically inactive or nickase versions of CRISPR-Cas nucleases to direct Apolipoprotein B mRNA editing enzyme, catalytic polypeptide-like (APOBEC) cytosine deaminases to cytosines that lie within an "editing window" in the R-loop induced by the CRISPR-Cas RNA-protein complex[2]. The most commonly used CBEs are the BE3[2] and BE4[3] fusions, which comprise the rat APOBEC1 (rAPOBEC1) cytosine deaminase fused to a nickase version of Cas9 (and also harbor one or two uracil glycosylase inhibitor (UGI) domains that minimize base excision repair of deaminated cytosines). rAPOBEC1-based CBEs have been used successfully in a wide variety of organisms and cell types to induce C to T changes in DNA[2-10]. Other cytosine deaminases such as human APOBEC3A[11, 12], an engineered form of human APOBEC3A[11], APOBEC3G[3], CDA1[3], and AID[3, 13-15] have also been used to create additional CBEs that function efficiently in human cells, hamster cells, yeast, rice, and tomato cells.

SUMMARY

Described herein are cytosine base editors that have reduced RNA editing activity. The base editors comprise a cytoside deaminase, e.g., an APOBEC1, bearing one or more mutations that decrease RNA editing activity while preserving DNA editing activity, wherein the mutations are at amino acid positions that correspond to residues P29, R33, K34, E181, and/or L182 of rat apolipoprotein B mRNA editing enzyme, catalytic polypeptide-like 1 (rAPOBEC1, SEQ ID NO:67), and a programmable DNA binding domain, and optionally further comprise a uracil glycosylase inhibitor (UGI).

In some embodiments, the cytosine deaminase comprises one or more mutations corresponding to APOBEC1 mutations at positions: P29F, P29T, R33A, K34A, R33A+K34A (double mutant), E181Q and/or L182A of SEQ ID NO:67 (rAPOBEC1, *Rattus norvegicus* APOBEC1) or an orthologue thereof. In some embodiments, the cytosine deaminase comprises one or more mutations corresponding to a mutation listed in table D.

In some embodiments, the base editors further comprise one or more mutations at APOBEC1 residues corresponding to E24, V25; R118, Y120, H121, R126; W224-K229; P168-1186; L173+L180; R15, R16, R17, to K15-17 & A15-17; Deletion E181-L210; P190+P191; Deletion L210-K229 (C-terminal); and/or Deletion S2-L14 (N-terminal) of SEQ ID NO:67 or an orthologue thereof.

In some embodiments, the cytosine base editor comprise a linker between the cytosine deaminase and the programmable DNA binding domain.

In some embodiments, the programmable DNA binding domain is selected from the group consisting of engineered C2H2 zinc-fingers, transcription activator effector-like effectors (TALEs), and Clustered Regularly Interspaced Short Palindromic Repeats (CRISPR) Cas RNA-guided nucleases (RGNs) and variants thereof. In some embodiments, the programmable DNA binding domain is an engineered C2H2 zinc-finger or TALEs that directs the base editor to edit a target sequence in Table E.

In some embodiments, the CRISPR RGN is an ssDNA nickase or is catalytically inactive, e.g., a Cas9 or Cas12a that is catalytically inactive or has ssDNA nickases activity.

Also provided herein are base editing systems comprising (i) the cytosine base editors described herein, wherein the programmable DNA binding domain is a CRISPR Cas RGN or a variant thereof; and (ii) at least one guide RNA compatible with the base editor that directs the base editor to a target sequence. In some embodiments, the guide RNA targets a sequence shown in Table E.

Also provided are isolated nucleic acids encoding the cytosine base editors; vectors comprising the isolated nucleic acids; and isolated host cells, preferably mammalian host cells, comprising the nucleic acids. In some embodiments, the isolated host cell expresses a cytosine base editor.

Further, provided herein are methods for deaminating a selected cytidine in a nucleic acid, the method comprising contacting the nucleic acid with a cytosine base editor or base editing system as described herein. In some embodiments, the method includes the use of a guide RNA that targets a sequence shown in Table E. In some embodiments, the nucleic acid is in a living cell. In some embodiments, the nucleic acid is genomic DNA, e.g., in a living cell.

In some embodiments, the cell is in a mammal, e.g., a human or a veterinary subject (e.g., dog, cat, cow, horse, pig, sheep, or goat).

Also provided are compositions comprising a purified cytosine base editor or base editing system as described herein. In some embodiments, the composition comprises one or more ribonucleoprotein (RNP) complexes.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DESCRIPTION OF DRAWINGS

FIG. 2 discloses SEQ ID NOS 1404-1405, respectively, in order of appearance.

FIGS. 4A-B. BE3 induces transcriptome-wide RNA-off-target mutations in two cell lines. In the experiments shown here, the HEK 293T and HepG2 cell lines were each transfected with plasmids expressing BE3 or nCas9-UGI (as a negative control) and a gRNA targeting a site in the human RNF2 gene. Edited cytosines are those that show significant editing to U in cells transfected with the BE3-encoding plasmid relative to cells transfected with the nCas9-UGI negative control. Panel (A) shows transcriptome-wide edited cytosines in HEK 293T cells in Manhattan plots with the y-axis representing percentage C to U editing and x-axis indicating chromosomal location. Also shown as pie charts are the distribution of substitutions detected (only relevant numbers of C>U and G>A were detected, with G>A representing C>U edits on the minus strand). The sequence logo of these edited sites shows a preference for 5' adenines preceding the edited cytosines. The metagene plot depicts an even distribution across most of the normalized gene body but a marked increase in edits towards the 3' end of genes. Panel (B) presents data on editing in HepG2 cells in the same format as in panel (A).

FIGS. 5A-B. Off-target RNA mutations induced by base editors are not targeted by the guide RNA spacer sequence. HEK 293T cells were transfected with plasmids expressing BE3 or nCas9-UGI and a gRNA either targeted or not targeted to a site in the human genome. Results from ultra-deep RNA-seq experiments are presented as in FIG. 4. RNA edits do not appear to depend on the sequence targeted by the gRNA co-expressed in these experiments, suggesting that RNA targeting is not required for inducing the off-target edits observed.

FIG. 6 discloses SEQ ID NOS 115, 112 and 111, respectively, in order of appearance.

FIG. 8 discloses SEQ ID NO: 1406.

FIG. 9A discloses SEQ ID NOS 1407-1408 and 1406, respectively, in order of appearance. FIG. 9B discloses SEQ ID NOS 1409-1411, respectively, in order of appearance. FIG. 9C discloses SEQ ID NOS 1412-1414, respectively, in order of appearance. FIG. 9D discloses SEQ ID NOS 1415-1417, respectively, in order of appearance.

FIG. 12A discloses SEQ ID NOS 1419-1420 and 1422-1466, respectively, in order of appearance. FIG. 12B discloses SEQ ID NOS 1419, 1467-1502, respectively, in order of appearance.

Figure 13B:
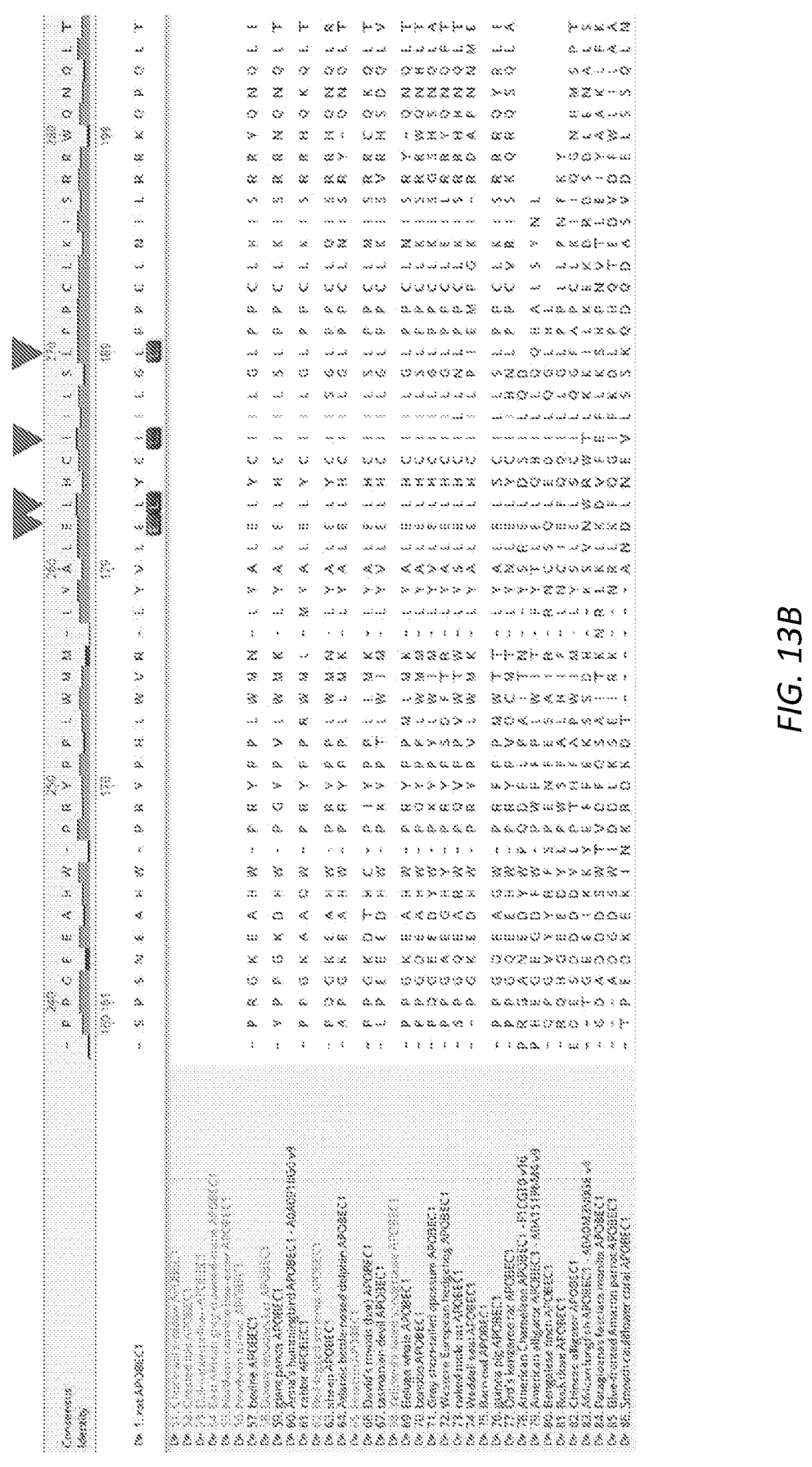

FIGS. 13A-13B. Alignment of APOBEC1 orthologues (C-terminal region). We aligned all APOBEC1 orthologues accessible on the uniprot platform to rAPOBEC1 amino acid sequence (13A, amino acids 1-50; 13B, amino acids 51-86). Arrowheads mark residues shown or predicted to reduce RNA editing or binding activities. Alignment was performed using Geneious7 software. This figure only depicts relevant C-terminal residues. Orthologues were ranked (numbers) by their similarity to rAPOBEC1. Each amino acid was ranked by its similarity across all species at the specific site (greyscale at each distribution, darker meaning higher conservation across species). FIG. 13A discloses SEQ ID NOS 1503-1542, respectively, in order of appearance. FIG. 13B discloses SEQ ID NOS 1503, 1543-1566, respectively, in order of appearance.

FIG. 14 discloses SEQ ID NOS 1421, 1418 and 1567-1586, respectively, in order of appearance.

FIG. 15. Alignment of exemplary APOBEC proteins. The following table provides the sequences shown in FIG. 15. Residues corresponding to P29, R33, K34, E181, and L182 of rAPOBEC1 (SEQ ID NO:67) are in bold.

| Accession | Description | SEQ ID NO: |
|---|---|---|
| NP_037039.1 | C->U-editing enzyme APOBEC-1 [*Rattus norvegicus*] | 67 |
| NP_112436.1 | C->U-editing enzyme APOBEC-1 [*Mus musculus*] | 97 |
| XP_001164661.1 | PREDICTED: C->U-editing enzyme APOBEC-1 isoform X2 [*Pan troglodytes*] | 98 |
| XP_543826.2 | C->U-editing enzyme APOBEC-1 [*Canis lupus familiaris*] | 99 |
| NP_001635.2 | C->U-editing enzyme APOBEC-1 isoform a [*Homo sapiens*] | 100 |
| XP_002687863.1 | C->U-editing enzyme APOBEC-1 [*Bos taurus*] | 101 |
| XP_001112583.1 | PREDICTED: c->U-editing enzyme APOBEC-1 isoform 2 [*Macaca mulatta*] | 102 |

Figure 16:
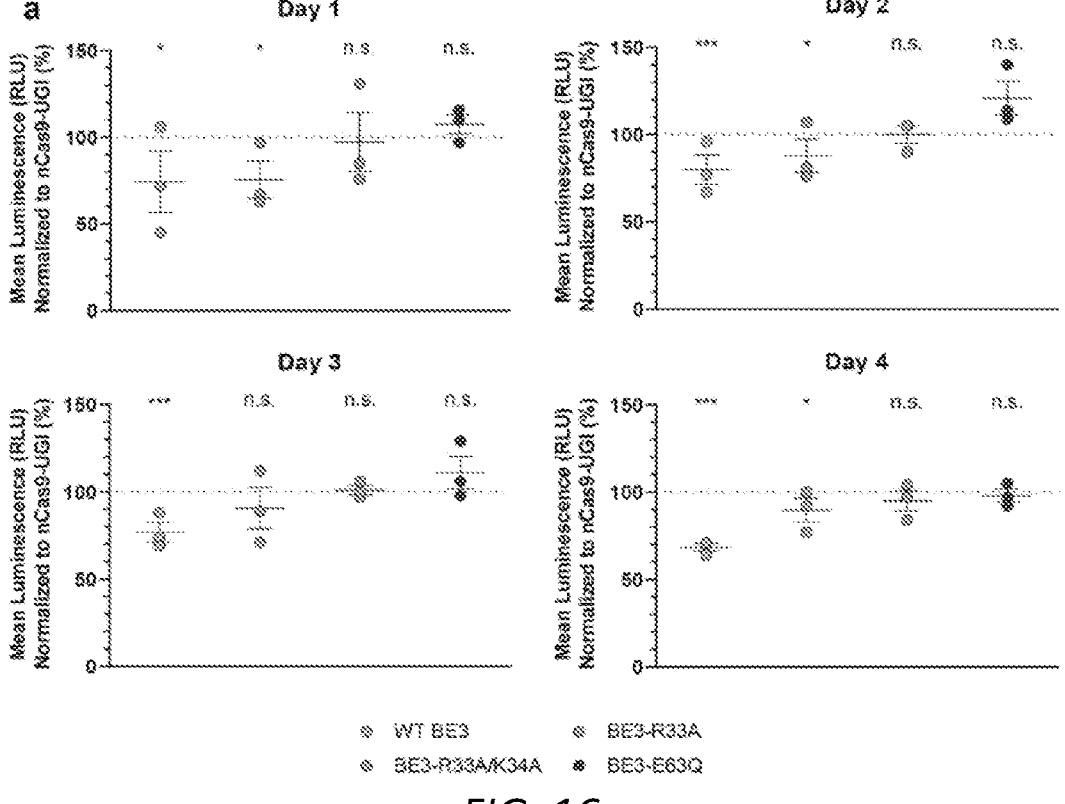

FIG. 16. Impacts of BE3 and SECURE-BE3 variants on cell viability. Cell viability assay comparing HEK293T cells transfected with plasmid expressing nCas9-UGI-NLS, wild-type (WT) BE3, BE3-R33A, BE3-R33A/K34A, or BE3-E63Q (shown left to right in each panel, n=3 biologically independent samples/condition). Each dot represents one biological replicate (and is the mean of three technical replicates). All data points were normalized to the mean luminescence of a nCas9-UGI-NLS control (set to 100%, grey dotted line) that was performed for each biological replicate experiment. The assay was performed on days 1, 2, 3, and 4 post-plating. Mean (longer horizontal line) and standard errors of the mean (shorter horizontal lines) are shown for each set of biological replicates. RLU=relative light unit; n.s.=not significantly decreased compared to matched nCas9 control; * and ***=$p<0.05$ and $p<0.001$ values, respectively, for a significant decrease compared to matched nCas9-UGI control. Statistical significance was determined as described in Supplementary Methods.

TABLE A

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| African elephant | G3U0R4 | version 30 of the entry and version 1 of the sequence | 1 |
| African lungfish | A0A0M3N0G8 | version 4 of the entry and version 1 of the sequence | 2 |
| American alligator | A0A151P6M4 | version 9 of the entry and version 1 of the sequence | 3 |
| American chameleon | F1CGT0 | version 16 of the entry and version 1 of the sequence | 4 |
| American crow | A0A091EQ78 | version 8 of the entry and version 1 of the sequence | 5 |
| Anna's hummingbird | A0A091IIG0 | version 9 of the entry and version 1 of the sequence | 6 |
| Atlantic bottle-nosed dolphin | A0A2U4ALA1 | version 2 of the entry and version 1 of the sequence | 7 |
| Barn owl | A0A093FY71 | version 6 of the entry and version 1 of the sequence | 8 |
| Black flying fox | L5KGJ8 | version 13 of the entry and version 1 of the sequence | 9 |
| Black snub-nosed monkey | A0A2K6KS69 | version 5 of the entry and version 1 of the sequence | 10 |
| Beluga whale | A0A2Y9NGP5 | version 1 of the entry and version 1 of the sequence | 11 |
| Bengalese finch | A0A218ULD2 | version 3 of the entry and version 1 of the sequence | 12 |
| Blue-fronted Amazon parrot | A0A0Q3WRD0 | version 5 of the entry and version 1 of the sequence | 13 |
| Bolivian squirrel monkey | A0A2K6U925 | version 5 of the entry and version 1 of the sequence | 14 |
| Bonobo | A0A2R9A0R0 | version 2 of the entry and version 1 of the sequence | 15 |

TABLE A-continued

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| Bornean orangutan | Q694B3 | version 60 of the entry and version 2 of the sequence | 16 |
| Bovine | E1BP99 | version 40 of the entry and version 1 of the sequence | 17 |
| Brandt's bat | S7PYX0 | version 9 of the entry and version 1 of the sequence | 18 |
| Cat | M3WB96 | version 31 of the entry and version 2 of the sequence | 19 |
| Cebus capucinus imitator | A0A2K5PZC0 | version 5 of the entry and version 1 of the sequence | 20 |
| Chimpanzee | H2Q5C6 | version 32 of the entry and version 1 of the sequence | 21 |
| Chinese alligator | A0A1U7S7K7 | version 5 of the entry and version 1 of the sequence | 22 |
| Chinese hamster | G3I1S7 | version 15 of the entry and version 1 of the sequence | 23 |
| Chuck-will's-widow | A0A094MFH1 | version 10 of the entry and version 1 of the sequence | 24 |
| Coquerel's sifaka | A0A2K6EVT9 | version 5 of the entry and version 1 of the sequence | 25 |
| Crab-eating macaque | G8F4P7 | version 11 of the entry and version 1 of the sequence | 26 |
| Crested ibis | A0A091V7F8 | version 9 of the entry and version 1 of the sequence | 27 |
| Dalmatian pelican | A0A091SSF0 | version 8 of the entry and version 1 of the sequence | 28 |
| Damaraland mole rat | A0A091CVE5 | version 9 of the entry and version 1 of the sequence | 29 |
| David's myotis | L5LUG3 | version 11 of the entry and version 1 of the sequence | 30 |
| Dog | F1PUJ5 | version 41 of the entry and version 2 of the sequence | 31 |
| Downy woodpecker | A0A093GVH6 | version 9 of the entry and | 32 |

TABLE A-continued

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| Drill | A0A2K5Z8Y4 | version 4 of the entry and version 1 of the sequence | 33 |
| East African grey crowned-crane | A0A087VMP5 | version 8 of the entry and version 1 of the sequence | 34 |
| Emperor penguin | A0A087QNJ5 | version 8 of the entry and version 1 of the sequence | 35 |
| Enhydra lutris kenyoni | A0A2Y9IYV0 | version 1 of the entry and version 1 of the sequence | 36 |
| European domestic ferret | B2NIW5 | version 34 of the entry and version 1 of the sequence | 37 |
| Florida manatee | A0A2Y9E587 | version 1 of the entry and version 1 of the sequence | 38 |
| Giant panda | G1LKL4 | version 27 of the entry and version 1 of the sequence | 39 |
| Golden-collared manakin | A0A093PWR2 | version 8 of the entry and version 1 of the sequence | 40 |
| Golden hamster | Q9EQP0 | version 73 of the entry and version 1 of the sequence | 41 |
| Golden snub-nosed monkey | A0A2K6PRF3 | version 4 of the entry and version 1 of the sequence | 42 |
| Green monkey | A0A0D9RBS4 | version 11 of the entry and version 1 of the sequence | 43 |
| Guinea pig | A0A286XNR2 | version 5 of the entry and version 1 of the sequence | 44 |
| Hawaiian monk seal | A0A2Y9HAT6 | version 1 of the entry and version 1 of the sequence | 45 |
| Hoatzin | A0A091XJL0 | version 8 of the entry and version 1 of the sequence | 46 |
| Horse | F6WR88 | version 28 of the entry and version 1 of the sequence | 47 |
| Human | P41238 | version 166 of the entry and version 3 of the sequence | 48 |
| Kea | A0A091RU17 | version 8 of the entry and version 1 of the sequence | 49 |

TABLE A-continued

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| Little egret | A0A091IWL9 | version 10 of the entry and version 1 of the sequence | 50 |
| Ma's night monkey | A0A2K5DG70 | version 6 of the entry and version 1 of the sequence | 51 |
| Mouse | P51908 | version 150 of the entry and version 1 of the sequence | 52 |
| Naked mole rat | G5BPM8 | version 16 of the entry and version 1 of the sequence | 53 |
| Northern carmine bee-eater | A0A091QEK6 | version 8 of the entry and version 1 of the sequence | 54 |
| Northern fulmar | A0A093LP85 | version 9 of the entry and version 1 of the sequence | 55 |
| Northern white-cheeked gibbon | G1QZV0 | version 31 of the entry and version 1 of the sequence | 56 |
| Olive baboon | A0A096MWB4 | version 19 of the entry and version 2 of the sequence | 57 |
| Gray short-tailed Opossum | Q9TUI7 | version 101 of the entry and version 1 of the sequence | 58 |
| Ord's kangaroo rat | A0A1S3FTE2 | version 3 of the entry and version 1 of the sequence | 59 |
| Pacific walrus | A0A2U3WPA5 | version 2 of the entry and version 1 of the sequence | 60 |
| Patagioenas fasciata monilis | A0A1V4JAP2 | version 3 of the entry and version 1 of the sequence | 61 |
| Peters' Angolan colobus | A0A2K5JKV4 | version 4 of the entry and version 1 of the sequence | 62 |
| Philippine tarsier | A0A1U7U8J6 | version 3 of the entry and version 1 of the sequence | 63 |
| Pig | F1SLW4 | version 37 of the entry and version 2 of the sequence | 64 |
| Pig-tailed macaque | A0A2K6BGI5 | version 4 of the entry and version 1 of the sequence | 65 |

TABLE A-continued

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| Rabbit | P47855 | version 96 of the entry and version 1 of the sequence | 66 |
| Rat | P38483 | version 137 of the entry and version 1 of the sequence | 67 |
| Red-legged seriema | A0A091M4D7 | version 10 of the entry and version 1 of the sequence | 68 |
| Red throated diver | A0A093F3R4 | version 8 of the entry and version 1 of the sequence | 69 |
| Rhesus macaque | G7N5W0 | version 19 of the entry and version 1 of the sequence | 70 |
| Rifleman (Acanthisitta chloris) | A0A091MEP8 | version 8 of the entry and version 1 of the sequence | 71 |
| Rock dove | A0A2I0LXZ8 | version 3 of the entry and version 1 of the sequence | 72 |
| Sheep | W5NVH9 | version 19 of the entry and version 1 of the sequence | 73 |
| Small-eared galago (Garnett's greater bushbaby) | H0XVG8 | version 27 of the entry and version 1 of the sequence | 74 |
| Smooth cauliflower coral | A0A2B4RXQ3 | version 4 of the entry and version 1 of the sequence | 75 |
| Sooty mangabey | A0A2K5L2J6 | version 5 of the entry and version 1 of the sequence | 76 |
| Sperm whale | A0A2Y9T649 | version 1 of the entry and version 1 of the sequence | 77 |
| Sumatran orangutan | H2NGD0 | version 24 of the entry and version 1 of the sequence. | 78 |
| Sunbittern | A0A093JI54 | version 8 of the entry and version 1 of the sequence | 79 |
| Tasmanian devil | G3W4I1 | version 32 of the entry and version 1 of the sequence | 80 |
| Weddell seal | A0A2U3Y3M5 | version 2 of the entry and version 1 of the sequence | 81 |
| Western European hedgehog | A0A1S3AN78 | version 3 of the entry and version 1 of the sequence | 82 |

TABLE A-continued

Exemplary APOBEC1 proteins. Residues corresponding to P29, R33, K34, E181, and L182 (as well as other candidates) of rAPOBEC1 (SEQ ID NO: 67) are marked with arrows in FIGS. 12A-12B and 13A-13B. The following table lists (in alphabetical order) the 86 APOBEC1 homologues aligned in FIGS. 12A-12B and 13A-13B.

| APOBEC1 orthologue | Uniprot accession number | Version number | Seq. ID |
|---|---|---|---|
| White tailed sea-eagle | A0A091PSV3 | version 8 of the entry and version 1 of the sequence | 83 |
| White tufted ear marmoset | F7F6M6 | version 31 of the entry and version 2 of the sequence | 84 |
| Wild yak | L8IDZ0 | version 15 of the entry and version 1 of the sequence | 85 |
| Yellow-throated sandgrouse | A0A093CIQ8 | version 5 of the entry and version 1 of the sequence | 86 |

TABLE B

Exemplary APOBEC/AID family proteins. Residues corresponding to P29, R33, K34, E181, and L182 (as well as prior and some future candidates) of rAPOBEC1 (SEQ ID NO: 67) are marked with arrows in FIG. 14. The following table lists (in alphabetical order) the APOBEC family homologues aligned in FIG. 14 and 15.

| APOBEC/ AID family homologue | Uniprot accession number | Version number | Seq. ID |
|---|---|---|---|
| Rat | P38483 | version 137 of the entry and version 1 of the sequence | 67 |
| Human AID (AICDA) | Q9GZX7 | version 155 of the entry and version 1 of the sequence | 87 |
| Human APOBEC1 | P41238 | version 166 of the entry and version 3 of the sequence | 48 |
| Human APOBEC2 | Q9Y235 | version 132 of the entry and version 1 of the sequence | 88 |
| Human APOBEC3A | P31941 | version 160 of the entry and version 3 of the sequence | 89 |
| Human APOBEC3B | Q9UH17 | version 150 of the entry and version 1 of the sequence | 90 |
| Human APOBEC3C | Q9NRW3 | version 147 of the entry and version 2 of the sequence | 91 |
| Human APOBEC3D | Q96AK3 | version 127 of the entry and version 1 of the sequence | 92 |
| Human APOBEC3F | Q8IUX4 | version 143 of the entry and version 3 of the sequence | 93 |

TABLE B-continued

Exemplary APOBEC/AID family proteins. Residues corresponding to
P29, R33, K34, E181, and L182 (as well as prior and some future
candidates) of rAPOBEC1 (SEQ ID NO: 67) are marked with arrows
in FIG. 14. The following table lists (in alphabetical order)
the APOBEC family homologues aligned in FIG. 14 and 15.

| APOBEC/ AID family homologue | Uniprot accession number | Version number | Seq. ID |
|---|---|---|---|
| Human APOBEC3G | Q9HC16 | version 168 of the entry and version 1 of the sequence | 94 |
| Human APOBEC3H | Q6NTF7 | version 115 of the entry and version 4 of the sequence | 95 |

DETAILED DESCRIPTION

Figure 1A:
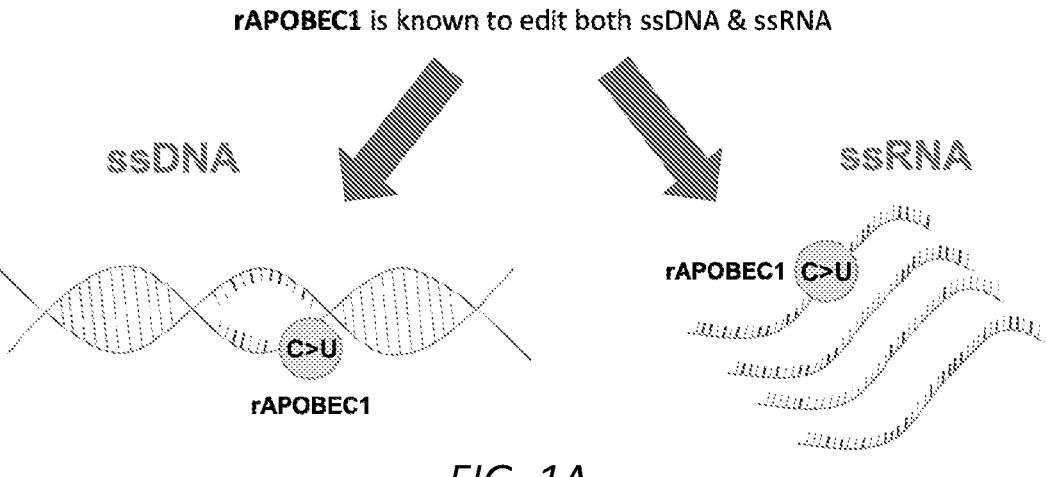
FIGS. 1A-B. rAPOBEC1 edits ssDNA and ssRNA. (A) rAPOBEC1 is known to target both single-stranded (ss) DNA (left) and ssRNA (right) inducing C>U alterations by deamination of the cytosine. (B) On the left, a base editor 3 (BE3) architecture targets the ssDNA bubble generated by one of its core components, nCas9. The deaminase, rAPOBEC1, deaminates a cytidine in the so-called editing window (~5 bp, spacer position 4-9) to uracil. The base editing localization was determined by a guide RNA (gRNA), which targets nCas9 to the genomic locus of interest. On the right, the same BE3 fusion protein is depicted as potentially targeting SSRNA.
Figure 1B:
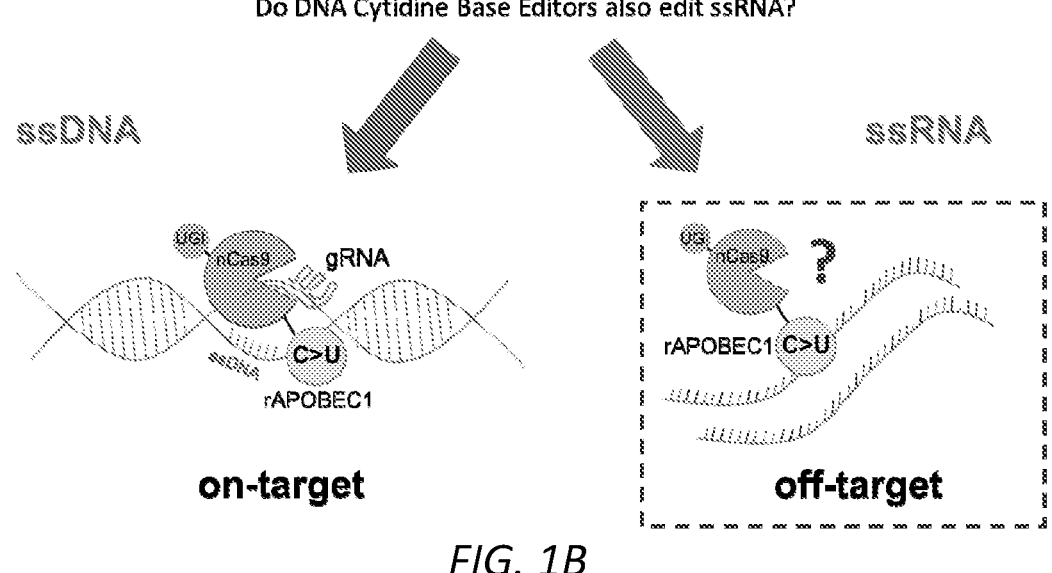

Although CBEs can efficiently induce C to T edits in DNA, the rAPOBEC1 protein (present in the most commonly used CBEs) was originally actually discovered based on its ability to induce C to U edits in RNA (FIG. 1A). Indeed, APOBEC stands for "apolipoprotein B mRNA editing enzyme, catalytic polypeptide-like" with APOBEC1 first identified as an enzyme that induces C to U editing of a specific C at position 6666 in the apoB gene[16, 17] Subsequent studies showed that APOBEC1 expression in mammalian cells could lead to C to U edits at multiple sites in the transcriptome beyond C6666, with a preference for the 3'UTR of mRNA transcripts and for Cs preceded by an adenine (A)[18-24]. Given this RNA editing capability of the isolated APOBEC1 enzyme, we sought to determine whether the BE3 editor might also exhibit this activity (FIG. 1B).

Thus, described herein are variants of APOBEC1 bearing mutations that exhibit reduced RNA editing (RRE) activities (also referred to herein as SElective Curbing of Unwanted RNA Editing (SECURE) variants) while maintaining DNA deamination activities, optionally fused to an engineered DNA binding domain such as a CRISPR-Cas nuclease modified to either be a nickase or catalytically inactive, to enable DNA base editing with reduced RNA mutation profiles.

Figure 14:
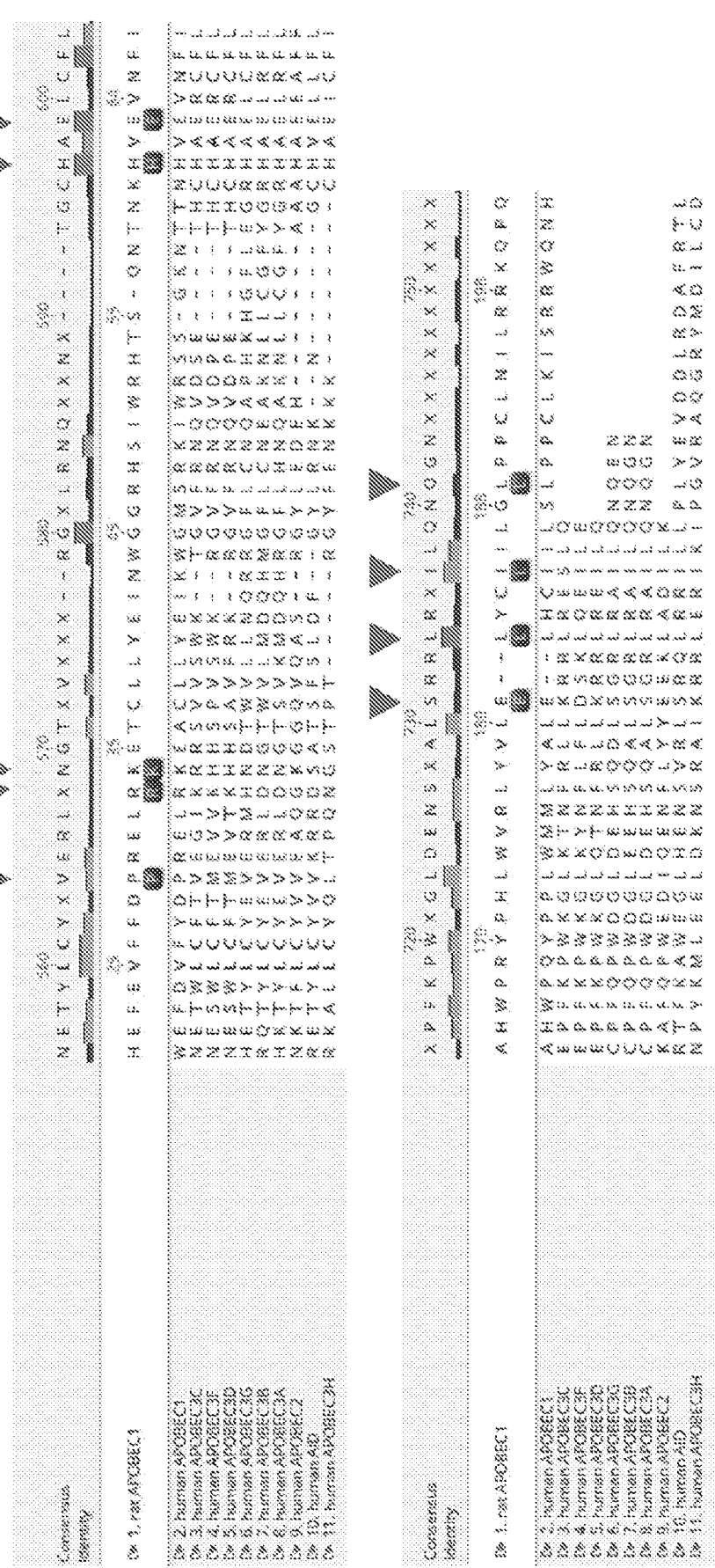
FIG. 14. Alignment of rAPOBEC1 to other homologous members of the human AID/APOBEC superfamily. We aligned rAPOBEC1 to all members of the human AID/ APOBEC superfamily using Geneious7 software. Arrowheads mark residues shown or predicted to reduce RNA editing or binding activities. Homologues were ranked (numbers) by their similarity to rAPOBEC1. Each amino acid was ranked by its similarity across all homologues at the specific site (greyscale at each distribution, darker meaning higher conservation across species).

In some embodiments, the APOBEC is APOBEC1 from rat, or from a different species, e.g., a different mammalian species such as human. The APOBEC family members have high sequence homology. FIGS. 12A-12B and 13A-13B show the alignment of APOBEC1 orthologues from other species listed in the uniprot database that are compatible with one or more of the claimed and/or prophetic variants in rAPOBEC1. FIG. 14 shows the alignment of members of the human APOBEC family of proteins to rAPOBEC1, highlighting comparable residues that are known or predicted to confer an RRE activity in these closely related proteins. FIG. 15 shows a full length alignment of six closely-related APOBEC homologs.

SElective Curbing of Unwanted RNA Editing (SECURE) Base Editor Variants

Thus described herein are base editors comprising cytosine deaminases with mutations that reduce undesirable RNA editing activity. In general, these base editors have mutations as described herein. In some embodiments, they have mutations that correspond to residues P29, R33, K34, E181, and/or L182 of rAPOBEC1. Alternatively, or in addition, they may have mutations at E24, V25; R118, Y120, H121, R126; W224-K229; P168-1186; L173+L180; R15, R16, R17, to K15-17 & A15-17; Deletion E181-L210; P190+P191; Deletion L210-K229 (C-terminal); and/or Deletion S2-L14 (N-terminal). In preferred embodiments, the mutations correspond to P29F, P29T, R33A, K34A, R33+K34A (double mutant), E181Q and/or L182A of SEQ ID NO:67 (rat APOBEC1).

The wild type sequence of rAPOBEC1, also known as C→U-editing enzyme APOBEC-1 [*Rattus norvegicus*], and available in GenBank at NP_037039.1, is as follows:

```
                                    (SEQ ID NO: 67)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLVVVRLYVLELYCIILGLPPCLNILRRK

QPQLTFFTIALQSCHYQRLPPHILWATGLK.
```

Other exemplary cytosine deaminase sequences are shown in FIGS. 12-15, and provided in Tables A and B. The ancestral rAPOBEC1 variants 655, 686, 687, 689 and 733 (Koblan et al, 2018) are listed as SEQ IDs 129-133. These variants of rAPOBEC1 also represent candidates for inclusion of the abovementioned mutations.

In some embodiments, the cytosine deaminase is evoFERNY (Thuronyi et al., Nature Biotechnology volume 37, pages 1070-1079 (2019)) and the R33 equivalent mutation can be made at R12.

```
evoFERNY(R12A):
nucleotide:
                                    (SEQ ID NO: 142)
TTTGAGAGGAACTACGACCCCCGGGAGCTGGCCAAGGAGACATACCTGCT

GTATGAGATCAAGTGGGGCAAGTCCGGCAAGCTGTGGAGGCACTGGTGCC

AGAACAATCGCACACAGCACGCCGAGGTGTACTTCCTGGAGAACATCTTT

AATGCCCGGAGATTCAATCCATCTACCCACTGTAGCATCACATGGTATCT

GAGCTGGTCCCCCTGCGCCGAGTGTTCTCAGAAGATCGTGGATTTCCTGA

AGGAGCACCCTAACGTGAATCTGGAGATCTATGTGGCCCGGCTGTACTAT

CCAGAGAACGAGAGGAATAGGCAGGGCCTGCGGGATCTGGTGAATTCCGG

CGTGACCATCAGAATCATGGACCTGCCAGATTACAACTATTGCTGGAAGA

CCTTCGTGAGCGATCAGGGAGGCGACGAGGATTACTGGCCAGGACACTTC

GCCCCTTGGATCAAGCAGTATAGCCTGAAGCTG amino acid:
                                    (SEQ ID NO: 143)
FERNYDPRELAKETYLLYEIKWGKSGKLWRHWCQNNRTQHAEVYFLENIF

NARRFNPSTHCSITVVYLSWSPCAECSQKIVDFLKEHPNVNLEIYVARLY

YPENERNRQGLRDLVNSGVTIRIMDLPDYNYCWKTFVSDQGGDEDYWPGH

FAPWIKQYSLKL.
```

In some embodiments, the cytosine deaminase is evoAPOBEC1 (Thuronyi et al., Nature Biotechnology volume 37, pages 1070-1079 (2019)) and the R33 and/or R34 equivalent mutations can be made at R33/R34.

```
evoFERNY(R12A/K13A):
nucleotide:
                                   (SEQ ID NO: 144)
TTTGAGAGGAACTACGACCCCCGGGAGCTGGCCGCCGAGACATACCTGCT

GTATGAGATCAAGTGGGGCAAGTCCGGCAAGCTGTGGAGGCACTGGTGCC

AGAACAATCGCACACAGCACGCCGAGGTGTACTTCCTGGAGAACATCTTT

AATGCCCGGAGATTCAATCCATCTACCCACTGTAGCATCACATGGTATCT

GAGCTGGTCCCCCTGCGCCGAGTGTTCTCAGAAGATCGTGGATTTCCTGA

AGGAGCACCCTAACGTGAATCTGGAGATCTATGTGGCCCGGCTGTACTAT

CCAGAGAACGAGAGGAATAGGCAGGGCCTGCGGGATCTGGTGAATTCCGG

CGTGACCATCAGAATCATGGACCTGCCAGATTACAACTATTGCTGGAAGA

CCTTCGTGAGCGATCAGGGAGGCGACGAGGATTACTGGCCAGGACACTTC

GCCCCTTGGATCAAGCAGTATAGCCTGAAGCTG, amino acid:
                                   (SEQ ID NO: 145)
FERNYDPRELAAETYLLYEIKWGKSGKLWRHWCQNNRTQHAEVYFLENIF

NARRFNPSTHCSITVVYLSWSPCAECSQKIVDFLKEHPNVNLEIYVARLY

YPENERNRQGLRDLVNSGVTIRIMDLPDYNYCWKTFVSDQGGDEDYWPGH

FAPWIKQYSLKL.
```

In some embodiments, the base editors do not include catalytically dead cytosine deaminase variants, e.g. E63A, W90S, and C93A. (Harris et al, 2002, PMID: 12453430).

Programmable DNA Binding Domain

In some embodiments, the base editors include programmable DNA binding domains such as engineered C2H2 zinc-fingers, transcription activator effector-like effectors (TALEs), and Clustered Regularly Interspaced Short Palindromic Repeats (CRISPR) Cas RNA-guided nucleases (RGNs) and their variants, including ssDNA nickases (nCas9) or their analogs and catalytically inactive dead Cas9 (dCas9) and its analogs, and any engineered protospacer-adjacent motif (PAM) or high-fidelity variants (e.g., as shown in Table D). A programmable DNA binding domain is one that can be engineered to bind to a selected target sequence.

CRISPR-Cas Nucleases

Although herein we refer to Cas9, in general any Cas9-like nickase could be used (including the related Cpf1/Cas12a enzyme classes), unless specifically indicated.

TABLE C

List of Exemplary Cas9 or Cas12a Orthologs

| Ortholog | UniProt or GenBank Accession Number | Nickase Mutations/ Catalytic residues |
|---|---|---|
| *S. pyogenes* Cas9 (SpCas9) | Q99ZW2.1 | D10A, E762A, H840A, N854A, N863A, D986A[17] |
| *S. aureus* Cas9 (SaCas9) | J7RUA5.1 | D10A and N580[18] |
| *S. thermophilus* Cas9 (StlCas9) | G3ECR1.2 | D31A and N891A[19] |
| *S. pasteurianus* Cas9 (SpaCas9) | BAK30384.1 | D10, H599* |

TABLE C-continued

List of Exemplary Cas9 or Cas12a Orthologs

| Ortholog | UniProt or GenBank Accession Number | Nickase Mutations/ Catalytic residues |
|---|---|---|
| *C. jejuni* Cas9 (CjCas9) | Q0P897.1 | D8A, H559A[20] |
| *F. novicida* Cas9 (FnCas9) | A0Q5Y3.1 | D11, N995[21] |
| *P. lavamentivorans* Cas9 (PlCas9) | A7HP89.1 | D8, H601* |
| *C. lari* Cas9 (ClCas9) | G1UFN3.1 | D7, H567* |
| *Pasteurella multocida* Cas9 | Q9CLT2.1 | |
| *F. novicida* Cpf1 (FnCpf1) | A0Q7Q2.1 | D917, E1006, D1255[21] |
| *M. bovoculi* Cpf1 (MbCpf1) | WP_052585281.1 | D986A** |
| *A. sp.* BV3L6 Cpf1 (AsCpf1) | U2UMQ6.1 | D908, 993E, Q1226, D1263[23] |
| *L. bacterium* N2006 (LbCpf1) | A0A182DWE3.1 | D832A[24] |

*predicted based on UniRule annotation on the UniProt database.
**Unpublished but deposited at addgene by Ervin Welker: pTE4565 (Addgene plasmid # 88903)

These orthologs, and mutants and variants thereof as known in the art, can be used in any of the fusion proteins described herein. See, e.g., WO 2017/040348 (which describes variants of SaCas9 and SpCas 9 with increased specificity) and WO 2016/141224 (which describes variants of SaCas9 and SpCas 9 with altered PAM specificity).

The Cas9 nuclease from *S. pyogenes* (hereafter simply Cas9) can be guided via simple base pair complementarity between 17-20 nucleotides of an engineered guide RNA (gRNA), e.g., a single guide RNA or crRNA/tracrRNA pair, and the complementary strand of a target genomic DNA sequence of interest that lies next to a protospacer adjacent motif (PAM), e.g., a PAM matching the sequence NGG or NAG (Shen et al., Cell Res (2013); Dicarlo et al., Nucleic Acids Res (2013); Jiang et al., Nat Biotechnol 31, 233-239 (2013); Jinek et al., Elife 2, e00471 (2013); Hwang et al., Nat Biotechnol 31, 227-229 (2013); Cong et al., Science 339, 819-823 (2013); *Mali* et al., Science 339, 823-826 (2013c); Cho et al., Nat Biotechnol 31, 230-232 (2013); Jinek et al., Science 337, 816-821 (2012)). The engineered CRISPR from *Prevotella* and *Francisella* 1 (Cpf1, also known as Cas12a) nuclease can also be used, e.g., as described in Zetsche et al., Cell 163, 759-771 (2015); Schunder et al., Int J Med Microbiol 303, 51-60 (2013); Makarova et al., Nat Rev Microbiol 13, 722-736 (2015); Fagerlund et al., Genome Biol 16, 251 (2015). Unlike SpCas9, Cpf1/Cas12a requires only a single 42-nt crRNA, which has 23 nt at its 3' end that are complementary to the protospacer of the target DNA sequence (Zetsche et al., 2015). Furthermore, whereas SpCas9 recognizes an NGG PAM sequence that is 3' of the protospacer, AsCpf1 and LbCp1 recognize TTTN PAMs that are found 5' of the protospacer (Id.).

In some embodiments, the present system utilizes a wild type or variant Cas9 protein from *S. pyogenes* or *Staphylococcus aureus*, or a wild type or variant Cpf1 protein from Acidaminococcus sp. BV3L6 or Lachnospiraceae bacterium ND2006 either as encoded in bacteria or codon-optimized for expression in mammalian cells and/or modified in its PAM recognition specificity and/or its genome-wide specificity. A number of variants have been described; see, e.g., WO 2016/141224, PCT/US2016/049147, Kleinstiver et al., Nat Biotechnol. 2016 August; 34(8):869-74; Tsai and Joung, Nat Rev Genet. 2016 May; 17(5):300-12; Kleinstiver et al., Nature. 2016 Jan. 28; 529(7587):490-5; Shmakov et al., Mol Cell. 2015 Nov. 5; 60(3): 385-97; Kleinstiver et al., Nat Biotechnol. 2015 December; 33(12):1293-1298; Dahlman et al., Nat Biotechnol. 2015 November; 33(11):1159-61; Kleinstiver et al., Nature. 2015 Jul. 23; 523(7561):481-5; Wyvekens et al., Hum Gene Ther. 2015 July; 26(7):425-31; Hwang et al., Methods Mol Biol. 2015; 1311:317-34; Osborn et al., Hum Gene Ther. 2015 February; 26(2):114-26; Konermann et al., Nature. 2015 Jan. 29; 517(7536):583-8; Fu et al., Methods Enzymol. 2014; 546:21-45; and Tsai et al., Nat Biotechnol. 2014 June; 32(6):569-76, inter alia. Concerning rAPOBEC1 itself, a number of variants have been described, e.g. Chen et al, RNA. 2010 May; 16 (5):1040-52; Chester et al, EMBO J. 2003 Aug. 1; 22(15): 3971-82; Teng et al, J Lipid Res. 1999 April; 40 (4):623-35; Navaratnam et al, Cell. 1995 Apr. 21; 81(2):187-95; MacGinnitie et al, J Biol Chem. 1995 Jun. 16; 270(24): 14768-75; Yamanaka et al, J Biol Chem. 1994 Aug. 26; 269(34):21725-34. The guide RNA is expressed or present in the cell together with the Cas9 or Cpf1. Either the guide RNA or the nuclease, or both, can be expressed transiently or stably in the cell or introduced as a purified protein or nucleic acid.

In some embodiments, the Cas9 also includes one of the following mutations, which reduce nuclease activity of the Cas9; e.g., for SpCas9, mutations at D10A or H840A (which creates a single-strand nickase).

In some embodiments, the SpCas9 variants also include mutations at one of each of the two sets of the following amino acid positions, which together destroy the nuclease activity of the Cas9: D10, E762, D839, H983, or D986 and H840 or N863, e.g., D10A/D10N and H840A/H840N/H840Y, to render the nuclease portion of the protein catalytically inactive; substitutions at these positions could be alanine (as they are in Nishimasu al., Cell 156, 935-949 (2014)), or other residues, e.g., glutamine, asparagine, tyrosine, serine, or aspartate, e.g., E762Q, H983N, H983Y, D986N, N863D, N863S, or N863H (see WO 2014/152432).

In some embodiments, the Cas9 is fused to one or more Uracil glycosylase inhibitor (UGI) protein sequences; an exemplary UGI sequence is as follows: TNLS-DIIEKETGKQLVIQESILMLPEEVEEVIGNKPESDIL-VHTAYDESTDENVMLLTSD APEYKPWALVIQDSN-GENKIKML (SEQ ID NO:134; Uniprot: P14739). Typically, the UGIs are at the C-terminus of a BE fusion protein, but can also be positioned at the N-terminus, or between the DNA binding domain and the deaminase domain. Linkers as known in the art can be used to separate domains.

TABLE D

| List of Exemplary High Fidelity and/or PAM-relaxed RGN Orthologs | | |
| --- | --- | --- |
| Published HF/PAM-RGN variants | PMID | Mutations* |
| S. pyogenes Cas9 (SpCas9) eSpCas9 | 26628643 | K810A/K1003A/R1060A (1.0); K848A/K1003A/R1060A(1.1) |
| S. pyogenes Cas9 (SpCas9) evoCas9 | 29431739 | M495V/Y515N/K526E/R661Q; (M495V/Y515N/K526E/R661S; M495V/Y515N/K526E/R661L) |
| S. pyogenes Cas9 (SpCas9) HF1 | 26735016 | N497A/R661A/Q695A/Q926A |

TABLE D-continued

| List of Exemplary High Fidelity and/or PAM-relaxed RGN Orthologs | | |
| --- | --- | --- |
| Published HF/PAM-RGN variants | PMID | Mutations* |
| S. pyogenes Cas9 (SpCas9) HiFi Cas9 | 30082871 | R691A |
| S. pyogenes Cas9 (SpCas9) HypaCas9 | 28931002 | N692A, M694A, Q695A, H698A |
| Published HF/PAM-RGN variants | PMID | Mutations* |
| S. pyogenes Cas9 (SpCas9) Sniper-Cas9 | 30082838 | F539S, M763I, K890N |
| S. pyogenes Cas9 (SpCas9) xCas9 | 29512652 | A262T, R324L, S409I, E480K, E543D, M694I, E1219V |
| S. pyogenes Cas9 (SpCas9) SpCas9-NG | 30166441 | R1335V, L1111R, D1135V, G1218R, E1219F, A1322R, T1337R |
| S. pyogenes Cas9 (SpCas9) VQR/VRER | 26098369 | D1135V, R1335Q, T1337R; D1135V/G1218R/R1335E/T1337R |
| S. aureus Cas9 (SaCas9)-KKH | 26524662 | E782K/N968K/R1015H |
| enAsCas12a | USSN 15/960, 271 | One or more of: E174R, S170R, S542R, K548R, K548V, N551R, N552R, K607R, K607H, e.g., E174R/S542R/K548R, E174R/S542R/K607R, E174R/S542R/K548V/N552R, S170R/S542R/K548R, S170R/E174R, E174R/S542R, S170R/S542R, E174R/S542R/K548R/N551R, E174R/S542R/K607H, S170R/S542R/K607R, or S170R/S542R/K548V/N552R |
| enAsCas12a-HF | USSN 15/960, 271 | One or more of: E174R, S542R, K548R, e.g., E174R/S542R/K548R, E174R/S542R/K607R, E174R/S542R/K548V/N552R, S170R/S542R/K548R, S170R/E174R, E174R/S542R, S170R/S542R, E174R/S542R/K548R/N551R, E174R/S542R/K607H, S170R/S542R/K607R, or S170R/S542R/K548V/N552R, with the addition of one or more of: N282A, T315A, N515A and K949A |
| enLbCas12a(HF) | USSN 15/960, 271 | One or more of T152R, T152K, D156R, D156K, Q529K, G532R, G532K, G532Q, K538R, K538V, D541R, Y542R, M592A, K595R, K595H, K595S or K595Q, e.g., D156R/G532R/K538R, D156R/G532R/K595R, D156R/G532R/K538V/Y542R, T152R/G532R/K538R, T152R/D156R, D156R/G532R, T152R/G532R, D156R/G532R/K538R/D541R, D156R/G532R/K595H, T152R/G532R/K595R, T152R/G532R/K538V/Y542R, optionally with the addition of one or more of: N260A, N256A, K514A, D505A, K881A, S286A, K272A, K897A |
| enFnCas12a(HF) | USSN 15/960, 271 | One or more of T177A, K180R, K180K, E184R, E184K, T604K, N607R, N607K, N607Q, K613R, K613V, D616R, N617R, M668A, K671R, K671H, K671S, or K671Q, e.g., E184R/N607R/K613R, E184R/N607R/K671R, E184R/N607R/K613V/N617R, |

TABLE D-continued

| List of Exemplary High Fidelity and/or PAM-relaxed RGN Orthologs | | |
| --- | --- | --- |
| Published HF/PAM-RGN variants | PMID | Mutations* |
| | | K180R/N607R/K613R, K180R/ E184R, E184R/N607R, K180R/ N607R, E184R/N607R/K613R/ D616R, E184R/N607R/K671H, K180R/N607R/K671R, K180R/ N607R/K613V/N617R, optionally with the addition of one or more of: N305A, N301A, K589A, N580A, K962A, S334A, K320A, K978A |

*predicted based on UniRule annotation on the UniProt database.

TAL Effector Repeat Arrays

Transcription activator like effectors (TALEs) of plant pathogenic bacteria in the genus *Xanthomonas* play important roles in disease, or trigger defense, by binding host DNA and activating effector-specific host genes. Specificity depends on an effector-variable number of imperfect, typically ~33-35 amino acid repeats. Polymorphisms are present primarily at repeat positions 12 and 13, which are referred to herein as the repeat variable-diresidue (RVD). The RVDs of TAL effectors correspond to the nucleotides in their target sites in a direct, linear fashion, one RVD to one nucleotide, with some degeneracy and no apparent context dependence. In some embodiments, the polymorphic region that grants nucleotide specificity may be expressed as a triresidue or triplet.

Each DNA binding repeat can include a RVD that determines recognition of a base pair in the target DNA sequence, wherein each DNA binding repeat is responsible for recognizing one base pair in the target DNA sequence. In some embodiments, the RVD can comprise one or more of: HA for recognizing C; ND for recognizing C; HI for recognizing C; HN for recognizing G; NA for recognizing G; SN for recognizing G or A; YG for recognizing T; and NK for recognizing G, and one or more of: HD for recognizing C; NG for recognizing T; NI for recognizing A; NN for recognizing G or A; NS for recognizing A or C or G or T; N* for recognizing C or T, wherein * represents a gap in the second position of the RVD; HG for recognizing T; H* for recognizing T, wherein * represents a gap in the second position of the RVD; and IG for recognizing T.

TALE proteins may be useful in research and biotechnology as targeted chimeric nucleases that can facilitate homologous recombination in genome engineering (e.g., to add or enhance traits useful for biofuels or biorenewables in plants). These proteins also may be useful as, for example, transcription factors, and especially for therapeutic applications requiring a very high level of specificity such as therapeutics against pathogens (e.g., viruses) as non-limiting examples.

Methods for generating engineered TALE arrays are known in the art, see, e.g., the fast ligation-based automatable solid-phase high-throughput (FLASH) system described in U.S. Ser. No. 61/610,212, and Reyon et al., Nature Biotechnology 30,460-465 (2012); as well as the methods described in Bogdanove & Voytas, Science 333, 1843-1846 (2011); Bogdanove et al., Curr Opin Plant Biol 13, 394-401 (2010); Scholze & Boch, J. Curr Opin Microbiol (2011); Boch et al., Science 326, 1509-1512 (2009); Moscou & Bogdanove, Science 326, 1501 (2009); Miller et al., Nat Biotechnol 29, 143-148 (2011); Morbitzer et al., T.

Proc Natl Acad Sci USA 107, 21617-21622 (2010); Morbitzer et al., Nucleic Acids Res 39, 5790-5799 (2011); Zhang et al., Nat Biotechnol 29, 149-153 (2011); Geissler et al., PLOS ONE 6, e19509 (2011); Weber et al., PLOS ONE 6, e19722 (2011); Christian et al., Genetics 186, 757-761 (2010); Li et al., Nucleic Acids Res 39, 359-372 (2011); Mahfouz et al., Proc Natl Acad Sci USA 108, 2623-2628 (2011); Mussolino et al., Nucleic Acids Res (2011); Li et al., Nucleic Acids Res 39, 6315-6325 (2011); Cermak et al., Nucleic Acids Res 39, e82 (2011); Wood et al., Science 333, 307 (2011); Hockemeye et al. Nat Biotechnol 29, 731-734 (2011); Tesson et al., Nat Biotechnol 29, 695-696 (2011); Sander et al., Nat Biotechnol 29, 697-698 (2011); Huang et al., Nat Biotechnol 29, 699-700 (2011); and Zhang et al., Nat Biotechnol 29, 149-153 (2011); all of which are incorporated herein by reference in their entirety.

Zinc Fingers

Zinc finger (ZF) proteins are DNA-binding proteins that contain one or more zinc fingers, independently folded zinc-containing mini-domains, the structure of which is well known in the art and defined in, for example, Miller et al., 1985, EMBO J., 4:1609; Berg, 1988, Proc. Natl. Acad. Sci. USA, 85:99; Lee et al., 1989, Science. 245:635; and Klug, 1993, Gene, 135:83. Crystal structures of the zinc finger protein Zif268 and its variants bound to DNA show a semi-conserved pattern of interactions, in which typically three amino acids from the alpha-helix of the zinc finger contact three adjacent base pairs or a "subsite" in the DNA (Pavletich et al., 1991, Science, 252:809; Elrod-Erickson et al., 1998, Structure, 6:451). Thus, the crystal structure of Zif268 suggested that zinc finger DNA-binding domains might function in a modular manner with a one-to-one interaction between a zinc finger and a three-base-pair "subsite" in the DNA sequence. In naturally occurring zinc finger transcription factors, multiple zinc fingers are typically linked together in a tandem array to achieve sequence-specific recognition of a contiguous DNA sequence (Klug, 1993, Gene 135:83).

Multiple studies have shown that it is possible to artificially engineer the DNA binding characteristics of individual zinc fingers by randomizing the amino acids at the alpha-helical positions involved in DNA binding and using selection methodologies such as phage display to identify desired variants capable of binding to DNA target sites of interest (Rebar et al., 1994, Science, 263:671; Choo et al., 1994 Proc. Natl. Acad. Sci. USA, 91:11163; Jamieson et al., 1994, Biochemistry 33:5689; Wu et al., 1995 Proc. Natl. Acad. Sci. USA, 92:344). Such recombinant zinc finger proteins can be fused to functional domains, such as transcriptional activators, transcriptional repressors, methylation domains, and nucleases to regulate gene expression, alter DNA methylation, and introduce targeted alterations into genomes of model organisms, plants, and human cells (Carroll, 2008, Gene Ther., 15:1463-68; Cathomen, 2008, Mol. Ther., 16:1200-07; Wu et al., 2007, Cell. Mol. Life Sci., 64:2933-44).

One existing method for engineering zinc finger arrays, known as "modular assembly," advocates the simple joining together of pre-selected zinc finger modules into arrays (Segal et al., 2003, Biochemistry, 42:2137-48; Beerli et al., 2002, Nat. Biotechnol., 20:135-141; Mandell et al., 2006, Nucleic Acids Res., 34: W516-523; Carroll et al., 2006, Nat. Protoc. 1:1329-41; Liu et al., 2002, J. Biol. Chem., 277: 3850-56; Bae et al., 2003, Nat. Biotechnol., 21:275-280; Wright et al., 2006, Nat. Protoc., 1:1637-52). Although straightforward enough to be practiced by any researcher, recent reports have demonstrated a high failure rate for this method, particularly in the context of zinc finger nucleases (Ramirez et al., 2008, Nat. Methods, 5:374-375; Kim et al., 2009, Genome Res. 19:1279-88), a limitation that typically necessitates the construction and cell-based testing of very large numbers of zinc finger proteins for any given target gene (Kim et al., 2009, Genome Res. 19:1279-88).

Combinatorial selection-based methods that identify zinc finger arrays from randomized libraries have been shown to have higher success rates than modular assembly (Maeder et al., 2008, Mol. Cell, 31:294-301; Joung et al., 2010, Nat. Methods, 7:91-92; Isalan et al., 2001, Nat. Biotechnol., 19:656-660). In preferred embodiments, the zinc finger arrays are described in, or are generated as described in, WO 2011/017293 and WO 2004/099366. Additional suitable zinc finger DBDs are described in U.S. Pat. Nos. 6,511,808, 6,013,453, 6,007,988, and 6,503,717 and U.S. patent application 2002/0160940.

Variants

In some embodiments, the components of the fusion proteins are at least 80%, e.g., at least 85%, 90%, 95%, 97%, or 99% identical to the amino acid sequence of a exemplary sequence (e.g., as provided herein), e.g., have differences at up to 1%, 2%, 5%, 10%, 15%, or 20% of the residues of the exemplary sequence replaced, e.g., with conservative mutations, e.g., including or in addition to the mutations described herein. In preferred embodiments, the variant retains a desired activity of the parent, e.g., deaminase activity, and/or the ability to interact with a guide RNA and/or target DNA, optionally with improved specificity or altered substrate specificity.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences. Percent identity between two polypeptides or nucleic acid sequences is determined in various ways that are within the skill in the art, for instance, using publicly available computer software such as Smith Waterman Alignment (Smith, T. F. and M. S. Waterman (1981) J Mol Biol 147:195-7); "BestFit" (Smith and Waterman, Advances in Applied Mathematics, 482-489 (1981)) as incorporated into GeneMatcher Plus™, Schwarz and Dayhof (1979) Atlas of Protein Sequence and Structure, Dayhof, M. O., Ed, pp 353-358; BLAST program (Basic Local Alignment Search Tool; (Altschul, S. F., W. Gish, et al. (1990) J Mol Biol 215:403-10), BLAST-2, BLAST-P, BLAST-N, BLAST-X, WU-BLAST-2, ALIGN, ALIGN-2, CLUSTAL, or Megalign (DNASTAR) software. In addition, those skilled in the art can determine appropriate parameters for measuring alignment, including any algorithms needed to achieve maximal alignment over the length of the sequences being compared. In general, for proteins or nucleic acids, the length of comparison can be any length, up to and including full length (e.g., 5%, 10%, 20%, 30%, 40%, 50%, 60%, 70%, 80%, 90%, 95%, or 100%). For purposes of the present compositions and methods, at least 80% of the full length of the sequence is aligned.

For purposes of the present disclosure, the comparison of sequences and determination of percent identity between two sequences can be accomplished using a Blossum 62 scoring matrix with a gap penalty of 12, a gap extend penalty of 4, and a frameshift gap penalty of 5.

Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine.

Also provided herein are isolated nucleic acids encoding the base editor fusion proteins, vectors comprising the isolated nucleic acids, optionally operably linked to one or more regulatory domains for expressing the variant proteins, and host cells, e.g., mammalian host cells, comprising the nucleic acids, and optionally expressing the variant proteins. In some embodiments, the host cells are stem cells, e.g., hematopoietic stem cells.

In some embodiments, the fusion proteins include a linker between the DNA binding domain (e.g., ZFN, TALE, or nCas9) and the BE domains. Linkers that can be used in these fusion proteins (or between fusion proteins in a concatenated structure) can include any sequence that does not interfere with the function of the fusion proteins. In preferred embodiments, the linkers are short, e.g., 2-20 amino acids, and are typically flexible (i.e., comprising amino acids with a high degree of freedom such as glycine, alanine, and serine). In some embodiments, the linker comprises one or more units consisting of GGGS (SEQ ID NO:135) or GGGGS (SEQ ID NO: 136), e.g., two, three, four, or more repeats of the GGGS (SEQ ID NO: 135) or GGGGS (SEQ ID NO:136) unit. Other linker sequences can also be used.

In some embodiments, the deaminase fusion protein includes a cell-penetrating peptide sequence that facilitates delivery to the intracellular space, e.g., HIV-derived TAT peptide, penetratins, transportans, or hCT derived cell-penetrating peptides, see, e.g., Caron et al., (2001) Mol Ther. 3(3): 310-8; Langel, Cell-Penetrating Peptides: Processes and Applications (CRC Press, Boca Raton FL 2002); El-Andaloussi et al., (2005) Curr Pharm Des. 11(28): 3597-611; and Deshayes et al., (2005) Cell Mol Life Sci. 62(16): 1839-49.

Cell penetrating peptides (CPPs) are short peptides that facilitate the movement of a wide range of biomolecules across the cell membrane into the cytoplasm or other organelles, e.g. the mitochondria and the nucleus. Examples of molecules that can be delivered by CPPs include therapeutic drugs, plasmid DNA, oligonucleotides, siRNA, peptide-nucleic acid (PNA), proteins, peptides, nanoparticles, and liposomes. CPPs are generally 30 amino acids or less, are derived from naturally or non-naturally occurring protein or chimeric sequences, and contain either a high relative abundance of positively charged amino acids, e.g. lysine or arginine, or an alternating pattern of polar and non-polar amino acids. CPPs that are commonly used in the art include Tat (Frankel et al., (1988) Cell. 55:1189-1193, Vives et al., (1997) J. Biol. Chem. 272:16010-16017), penetratin (Derossi et al., (1994) J. Biol. Chem. 269:10444-10450), polyarginine peptide sequences (Wender et al., (2000) Proc. Natl. Acad. Sci. USA 97:13003-13008, Futaki et al., (2001)

J. Biol. Chem. 276:5836-5840), and transportan (Pooga et al., (1998) Nat. Biotechnol. 16:857-861).

CPPs can be linked with their cargo through covalent or non-covalent strategies. Methods for covalently joining a CPP and its cargo are known in the art, e.g. chemical cross-linking (Stetsenko et al., (2000) J. Org. Chem. 65:4900-4909, Gait et al. (2003) Cell. Mol. Life. Sci. 60:844-853) or cloning a fusion protein (Nagahara et al., (1998) Nat. Med. 4:1449-1453). Non-covalent coupling between the cargo and short amphipathic CPPs comprising polar and non-polar domains is established through electrostatic and hydrophobic interactions.

CPPs have been utilized in the art to deliver potentially therapeutic biomolecules into cells. Examples include cyclosporine linked to polyarginine for immunosuppression (Rothbard et al., (2000) Nature Medicine 6 (11): 1253-1257), siRNA against cyclin B1 linked to a CPP called MPG for inhibiting tumorigenesis (Crombez et al., (2007) Biochem Soc. Trans. 35:44-46), tumor suppressor p53 peptides linked to CPPs to reduce cancer cell growth (Takenobu et al., (2002) Mol. Cancer Ther. 1 (12): 1043-1049, Snyder et al., (2004) PLOS Biol. 2: E36), and dominant negative forms of Ras or phosphoinositol 3 kinase (PI3K) fused to Tat to treat asthma (Myou et al., (2003) J. Immunol. 171:4399-4405).

CPPs have been utilized in the art to transport contrast agents into cells for imaging and biosensing applications. For example, green fluorescent protein (GFP) attached to Tat has been used to label cancer cells (Shokolenko et al., (2005) DNA Repair 4 (4): 511-518). Tat conjugated to quantum dots have been used to successfully cross the blood-brain barrier for visualization of the rat brain (Santra et al., (2005) Chem. Commun. 3144-3146). CPPs have also been combined with magnetic resonance imaging techniques for cell imaging (Liu et al., (2006) Biochem. and Biophys. Res. Comm. 347(1):133-140). See also Ramsey and Flynn, Pharmacol Ther. 2015 Jul. 22. pii: S0163-7258 (15) 00141-2.

Alternatively or in addition, the deaminase fusion proteins can include a nuclear localization sequence, e.g., SV40 large T antigen NLS (PKKKRRV (SEQ ID NO: 137)) and nucleoplasmin NLS (KRPAATKKAGQAKKKK (SEQ ID NO:138)). Other NLSs are known in the art; see, e.g., Cokol et al., EMBO Rep. 2000 Nov. 15; 1(5): 411-415; Freitas and Cunha, Curr Genomics. 2009 December; 10(8): 550-557.

In some embodiments, the deaminase fusion proteins include a moiety that has a high affinity for a ligand, for example GST, FLAG or hexahistidine (SEQ ID NO: 146) sequences. Such affinity tags can facilitate the purification of recombinant deaminase fusion proteins.

The deaminase fusion proteins described herein can be used for altering the genome of a cell. The methods generally include expressing or contacting the deaminase fusion proteins in the cells; in versions using one or two Cas9s, the methods include using a guide RNA having a region complementary to a selected portion of the genome of the cell. Methods for selectively altering the genome of a cell are known in the art, see, e.g., U.S. Pat. No. 8,993,233; US20140186958; U.S. Pat. No. 9,023,649; WO/2014/099744; WO 2014/089290; WO2014/144592; WO144288; WO2014/204578; WO2014/152432; WO2115/099850; U.S. Pat. No. 8,697,359; US20160024529; US20160024524; US20160024523; US20160024510; US20160017366; US20160017301; US20150376652; US20150356239; US20150315576; US20150291965; US20150252358; US20150247150; US20150232883; US20150232882; US20150203872; US20150191744; US20150184139; US20150176064; US20150167000; US20150166969;

US20150159175; US20150159174; US20150093473; US20150079681; US20150067922; US20150056629; US20150044772; US20150024500; US20150024499; US20150020223; US20140356867; US20140295557; US20140273235; US20140273226; US20140273037; US20140189896; US20140113376; US20140093941; US20130330778; US20130288251; US20120088676; US20110300538; US20110236530; US20110217739; US20110002889; US20100076057; US20110189776; US20110223638; US20130130248; US20150050699; US20150071899; US20150050699; US20150045546; US20150031134; US20150024500; US20140377868; US20140357530; US20140349400; US20140335620; US20140335063; US20140315985; US20140310830; US20140310828; US20140309487; US20140304853; US20140298547; US20140295556; US20140294773; US20140287938; US20140273234; US20140273232; US20140273231; US20140273230; US20140271987; US20140256046; US20140248702; US20140242702; US20140242700; US20140242699; US20140242664; US20140234972; US20140227787; US20140212869; US20140201857; US20140199767; US20140189896; US20140186958; US20140186919; US20140186843; US20140179770; US20140179006; US20140170753; WO/2008/108989; WO/2010/054108; WO/2012/164565; WO/2013/098244; WO/2013/176772; US20150071899; Makarova et al., "Evolution and classification of the CRISPR-Cas systems" 9 (6) Nature Reviews Microbiology 467-477 (1-23) (June 2011); Wiedenheft et al., "RNA-guided genetic silencing systems in bacteria and archaea" 482 Nature 331-338 (Feb. 16, 2012); Gasiunas et al., "Cas9-crRNA ribonucleoprotein complex mediates specific DNA cleavage for adaptive immunity in bacteria" 109 (39) Proceedings of the National Academy of Sciences USA E2579-E2586 (Sep. 4, 2012); Jinek et al., "A Programmable Dual-RNA-Guided DNA Endonuclease in Adaptive Bacterial Immunity" 337 Science 816-821 (Aug. 17, 2012); Carroll, "A CRISPR Approach to Gene Targeting" 20 (9) Molecular Therapy 1658-1660 (September 2012); U.S. Appl. No. 61/652,086, filed May 25, 2012; Al-Attar et al., Clustered Regularly Interspaced Short Palindromic Repeats (CRISPRs): The Hallmark of an Ingenious Antiviral Defense Mechanism in Prokaryotes, Biol Chem. (2011) vol. 392, Issue 4, pp. 277-289; Hale et al., Essential Features and Rational Design of CRISPR RNAs That Function With the Cas RAMP Module Complex to Cleave RNAs, Molecular Cell, (2012) vol. 45, Issue 3, 292-302.

For methods in which the deaminase fusion proteins are delivered to cells, the proteins can be produced using any method known in the art, e.g., by in vitro translation, or expression in a suitable host cell from nucleic acid encoding the deaminase fusion protein; a number of methods are known in the art for producing proteins. For example, the proteins can be produced in and purified from yeast, E. coli, insect cell lines, plants, transgenic animals, or cultured mammalian cells; see, e.g., Palomares et al., "Production of Recombinant Proteins: Challenges and Solutions," Methods Mol Biol. 2004; 267:15-52. In addition, the deaminase fusion proteins can be linked to a moiety that facilitates transfer into a cell, e.g., a lipid nanoparticle, optionally with a linker that is cleaved once the protein is inside the cell. See, e.g., LaFountaine et al., Int J Pharm. 2015 Aug. 13; 494(1): 180-194.

Expression Systems

To use the deaminase fusion proteins described herein, it may be desirable to express them from a nucleic acid that encodes them. This can be performed in a variety of ways.

For example, the nucleic acid encoding the deaminase fusion can be cloned into an intermediate vector for transformation into prokaryotic or eukaryotic cells for replication and/or expression. Intermediate vectors are typically prokaryote vectors, e.g., plasmids, or shuttle vectors, or insect vectors, for storage or manipulation of the nucleic acid encoding the deaminase fusion for production of the deaminase fusion protein. The nucleic acid encoding the deaminase fusion protein can also be cloned into an expression vector, for administration to a plant cell, animal cell, preferably a mammalian cell or a human cell, fungal cell, bacterial cell, or protozoan cell.

To obtain expression, a sequence encoding a deaminase fusion protein is typically subcloned into an expression vector that contains a promoter to direct transcription. Suitable bacterial and eukaryotic promoters are well known in the art and described, e.g., in Sambrook et al., Molecular Cloning, A Laboratory Manual (3d ed. 2001); Kriegler, Gene Transfer and Expression: A Laboratory Manual (1990); and Current Protocols in Molecular Biology (Ausubel et al., eds., 2010). Bacterial expression systems for expressing the engineered protein are available in, e.g., *E. coli, Bacillus* sp., and *Salmonella* (Palva et al., 1983, Gene 22:229-235). Kits for such expression systems are commercially available. Eukaryotic expression systems for mammalian cells, yeast, and insect cells are well known in the art and are also commercially available.

The promoter used to direct expression of a nucleic acid depends on the particular application. For example, a strong constitutive promoter is typically used for expression and purification of fusion proteins. In contrast, when the deaminase fusion protein is to be administered in vivo for gene regulation, either a constitutive or an inducible promoter can be used, depending on the particular use of the deaminase fusion protein. In addition, a preferred promoter for administration of the deaminase fusion protein can be a weak promoter, such as HSV TK or a promoter having similar activity. The promoter can also include elements that are responsive to transactivation, e.g., hypoxia response elements, Gal4 response elements, lac repressor response element, and small molecule control systems such as tetracycline-regulated systems and the RU-486 system (see, e.g., Gossen & Bujard, 1992, Proc. Natl. Acad. Sci. USA, 89:5547; Oligino et al., 1998, Gene Ther., 5:491-496; Wang et al., 1997, Gene Ther., 4:432-441; Neering et al., 1996, Blood, 88:1147-55; and Rendahl et al., 1998, Nat. Biotechnol., 16:757-761).

In addition to the promoter, the expression vector typically contains a transcription unit or expression cassette that contains all the additional elements required for the expression of the nucleic acid in host cells, either prokaryotic or eukaryotic. A typical expression cassette thus contains a promoter operably linked, e.g., to the nucleic acid sequence encoding the deaminase fusion protein, and any signals required, e.g., for efficient polyadenylation of the transcript, transcriptional termination, ribosome binding sites, or translation termination. Additional elements of the cassette may include, e.g., enhancers, and heterologous spliced intronic signals.

The particular expression vector used to transport the genetic information into the cell is selected with regard to the intended use of the deaminase fusion protein, e.g., expression in plants, animals, bacteria, fungus, protozoa, etc. Standard bacterial expression vectors include plasmids such as pBR322 based plasmids, pSKF, pET23D, and commercially available tag-fusion expression systems such as GST and LacZ.

Expression vectors containing regulatory elements from eukaryotic viruses are often used in eukaryotic expression vectors, e.g., SV40 vectors, papilloma virus vectors, and vectors derived from Epstein-Barr virus. Other exemplary eukaryotic vectors include pMSG, pAV009/A+, pMTO10/A+, pMAMneo-5, baculovirus pDSVE, and any other vector allowing expression of proteins under the direction of the SV40 early promoter, SV40 late promoter, metallothionein promoter, murine mammary tumor virus promoter, Rous sarcoma virus promoter, polyhedrin promoter, or other promoters shown effective for expression in eukaryotic cells.

The vectors for expressing the deaminase fusion protein can include RNA Pol III promoters to drive expression of the guide RNAs, e.g., the H1, U6 or 7SK promoters. These human promoters allow for expression of deaminase fusion protein in mammalian cells following plasmid transfection.

Some expression systems have markers for selection of stably transfected cell lines such as thymidine kinase, hygromycin B phosphotransferase, and dihydrofolate reductase. High yield expression systems are also suitable, such as using a baculovirus vector in insect cells, with the gRNA encoding sequence under the direction of the polyhedrin promoter or other strong baculovirus promoters.

The elements that are typically included in expression vectors also include a replicon that functions in *E. coli*, a gene encoding antibiotic resistance to permit selection of bacteria that harbor recombinant plasmids, and unique restriction sites in nonessential regions of the plasmid to allow insertion of recombinant sequences.

Standard transfection methods are used to produce bacterial, mammalian, yeast or insect cell lines that express large quantities of protein, which are then purified using standard techniques (see, e.g., Colley et al., 1989, J. Biol. Chem., 264:17619-22; Guide to Protein Purification, in Methods in Enzymology, vol. 182 (Deutscher, ed., 1990)). Transformation of eukaryotic and prokaryotic cells are performed according to standard techniques (see, e.g., Morrison, 1977, J. Bacteriol. 132:349-351; Clark-Curtiss & Curtiss, Methods in Enzymology 101:347-362 (Wu et al., eds, 1983).

Any of the known procedures for introducing foreign nucleotide sequences into host cells may be used. These include the use of calcium phosphate transfection, polybrene, protoplast fusion, electroporation, nucleofection, liposomes, microinjection, naked DNA, plasmid vectors, viral vectors, both episomal and integrative, and any of the other well-known methods for introducing cloned genomic DNA, cDNA, synthetic DNA or other foreign genetic material into a host cell (see, e.g., Sambrook et al., supra). It is only necessary that the particular genetic engineering procedure used be capable of successfully introducing at least one gene into the host cell capable of expressing the deaminase fusion protein.

In methods wherein the fusion proteins include a Cas9 domain, the methods also include delivering at least one gRNA that interacts with the Cas9, or a nucleic acid that encodes a gRNA.

Alternatively, the methods can include delivering the deaminase fusion protein and guide RNA together, e.g., as a complex. For example, the deaminase fusion protein and gRNA can be can be overexpressed in a host cell and purified, then complexed with the guide RNA (e.g., in a test tube) to form a ribonucleoprotein (RNP), and delivered to cells. In some embodiments, the deaminase fusion protein can be expressed in and purified from bacteria through the use of bacterial expression plasmids. For example, His-tagged deaminase fusion protein can be expressed in bacterial cells and then purified using nickel affinity chromatography. The use of RNPs circumvents the necessity of delivering plasmid DNAs encoding the nuclease or the guide, or encoding the nuclease as an mRNA. RNP delivery may also improve specificity, presumably because the half-life of the RNP is shorter and there's no persistent expression of the nuclease and guide (as you'd get from a plasmid). The RNPs can be delivered to the cells in vivo or in vitro, e.g., using lipid-mediated transfection or electroporation. See, e.g., Liang et al. "Rapid and highly efficient mammalian cell engineering via Cas9 protein transfection." Journal of biotechnology 208 (2015): 44-53; Zuris, John A., et al. "Cationic lipid-mediated delivery of proteins enables efficient protein-based genome editing in vitro and in vivo." Nature biotechnology 33.1 (2015): 73-80; Kim et al. "Highly efficient RNA-guided genome editing in human cells via delivery of purified Cas9 ribonucleoproteins." Genome research 24.6 (2014): 1012-1019.

The present invention also includes the vectors and cells comprising the vectors, as well as kits comprising the proteins and nucleic acids described herein, e.g., for use in a method described herein.

Methods of Use

The base editors described herein can be used to deaminate a selected cytosine in a nucleic acid sequence, e.g., in a cell, e.g., a cell in an animal (e.g., a mammal such as a human or veterinary subject), or a synthetic nucleic acid substrate. The methods include contacting the nucleic acid with a base editor as described herein. Where the base editor includes a CRISPR Cas9 or Cas12a protein, the methods further include the use of one or more guide RNAs that direct binding of the base editor to a sequence to be deaminated.

For example, the base editors described herein can be used for in vitro, in vivo or in situ directed evolution, e.g., to engineer polypeptides or proteins based on a synthetic selection framework, e.g. antibiotic resistance in *E. coli* or resistance to anti-cancer therapeutics being assayed in mammalian cells (e.g. CRISPR-X Hess et al, PMID: 27798611 or BE-plus systems Jiang et al, PMID: 29875396).

In addition, the base editors can be used to base-edit a therapeutically relevant sequence, to treat a subject. Table E provides a list of disease-associated gene variants that could be base-edited therapeutically with an NGG PAM positioned appropriately. See, e.g., Komor et al, Nature 2016).

TABLE E

Figure 8:
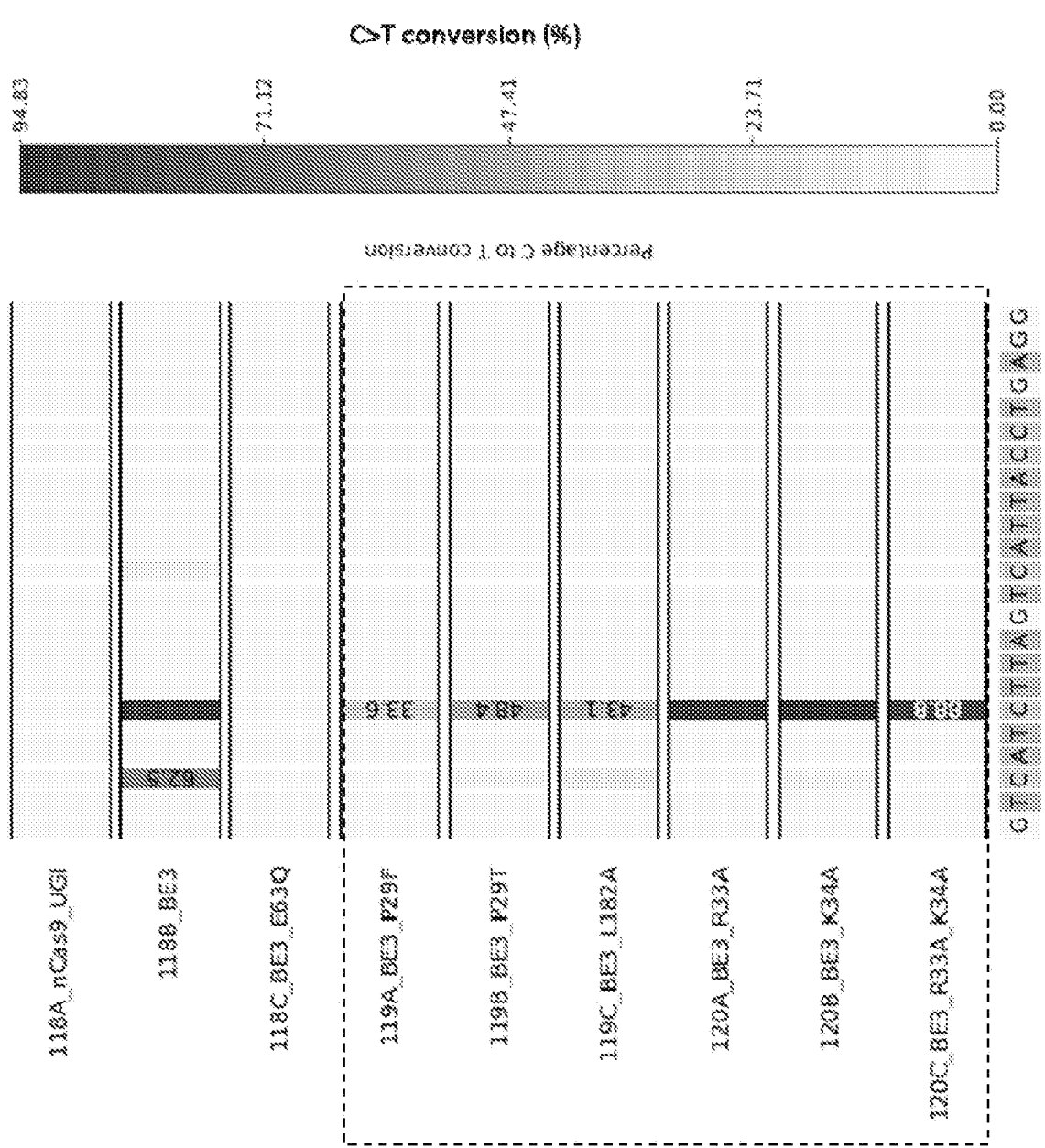
FIG. 8. DNA base editing efficiencies of BE3 variants with reduced RNA base editing activities assessed with a single gRNA. Six BE3 variants harboring APOBEC1 mutations were assessed for their DNA base editing activities by targeted amplicon sequencing of the RNF2 gene site targeted by a co-expressed gRNA. In addition, nCas9-UGI-NLS (negative control) and wild-type (WT) BE3 (positive control) were also assessed for their DNA editing activities. Genomic DNA used for these experiments was isolated from the same cells from which RNA was isolated to characterize the transcriptome-wide RNA editing activities of these variants (the results of which are shown in Table 2). C>T editing frequencies are depicted in heat map format, with darker color indicating higher efficiencies.
Figure 9A:
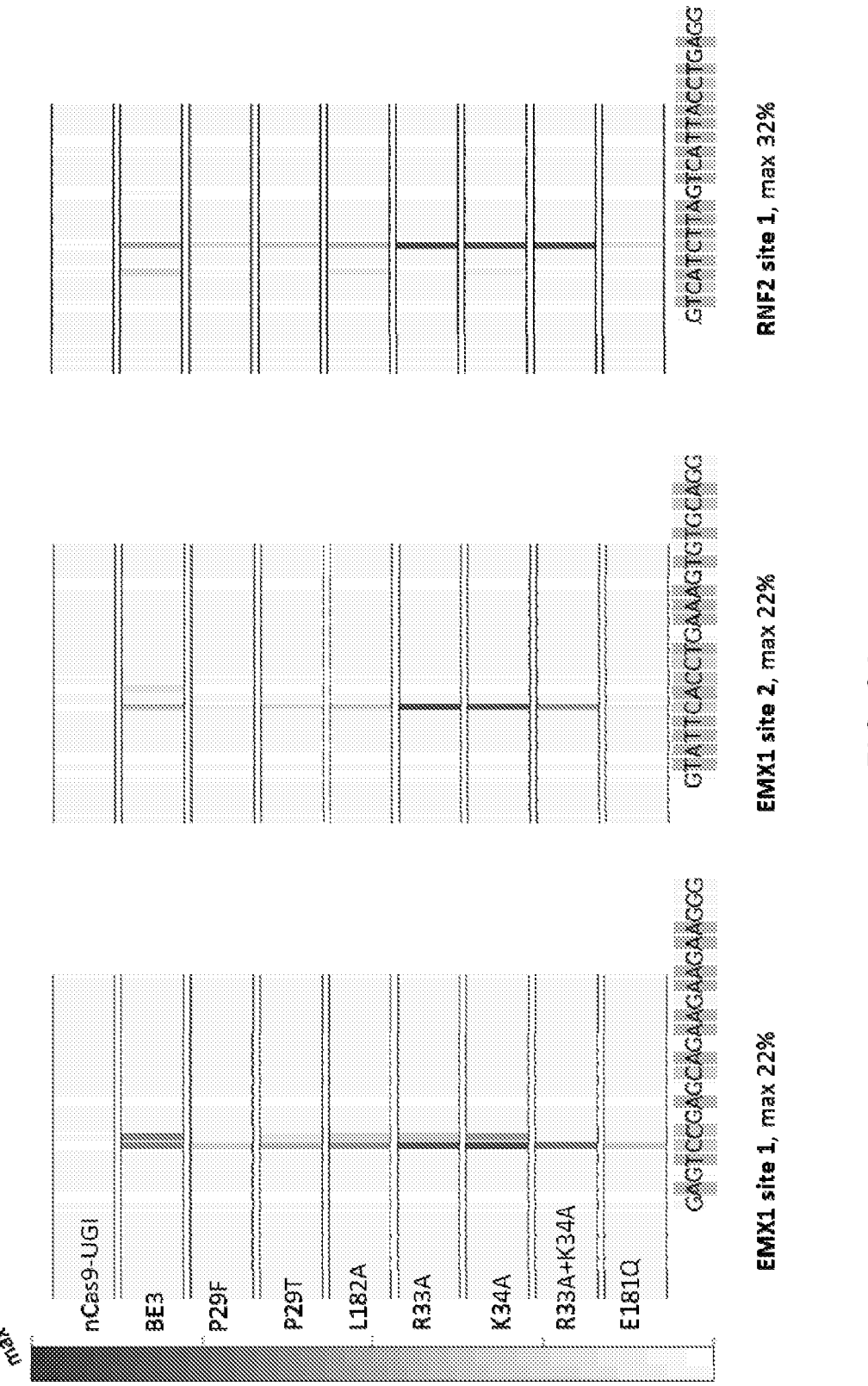
FIGS. 9A-D. DNA base editing efficiencies of BE3 variants with reduced RNA base editing activities assessed with multiple different gRNAs. Six BE3 variants harboring APOBEC1 mutations were assessed for their DNA base editing activities by targeted amplicon sequencing of 12 different human gene sites targeted by a co-expressed gRNA. In addition, nCas9-UGI-NLS (negative control) and wild-type (WT) BE3 (positive control) were also assessed for their DNA editing activities in parallel. These experiments were conducted in biological quadruplicate and a single representative example is shown for each. C>T editing frequencies are depicted in heat map format, with darker color indicating higher efficiencies. Overall, C>T editing of SElective Curbing of Unwanted RNA Editing (SECURE) BE variants seems comparable to WT-BE3. L182A, R33A, K34A and R33A+K34A seem to produce higher overall editing rates compared to P29F, P29T and E181Q. R33A+ K34A shows a strong preference for cytidines in a 5'T context. In addition, note that many variants have a propensity for a more narrowed editing window.
Figure 9B:
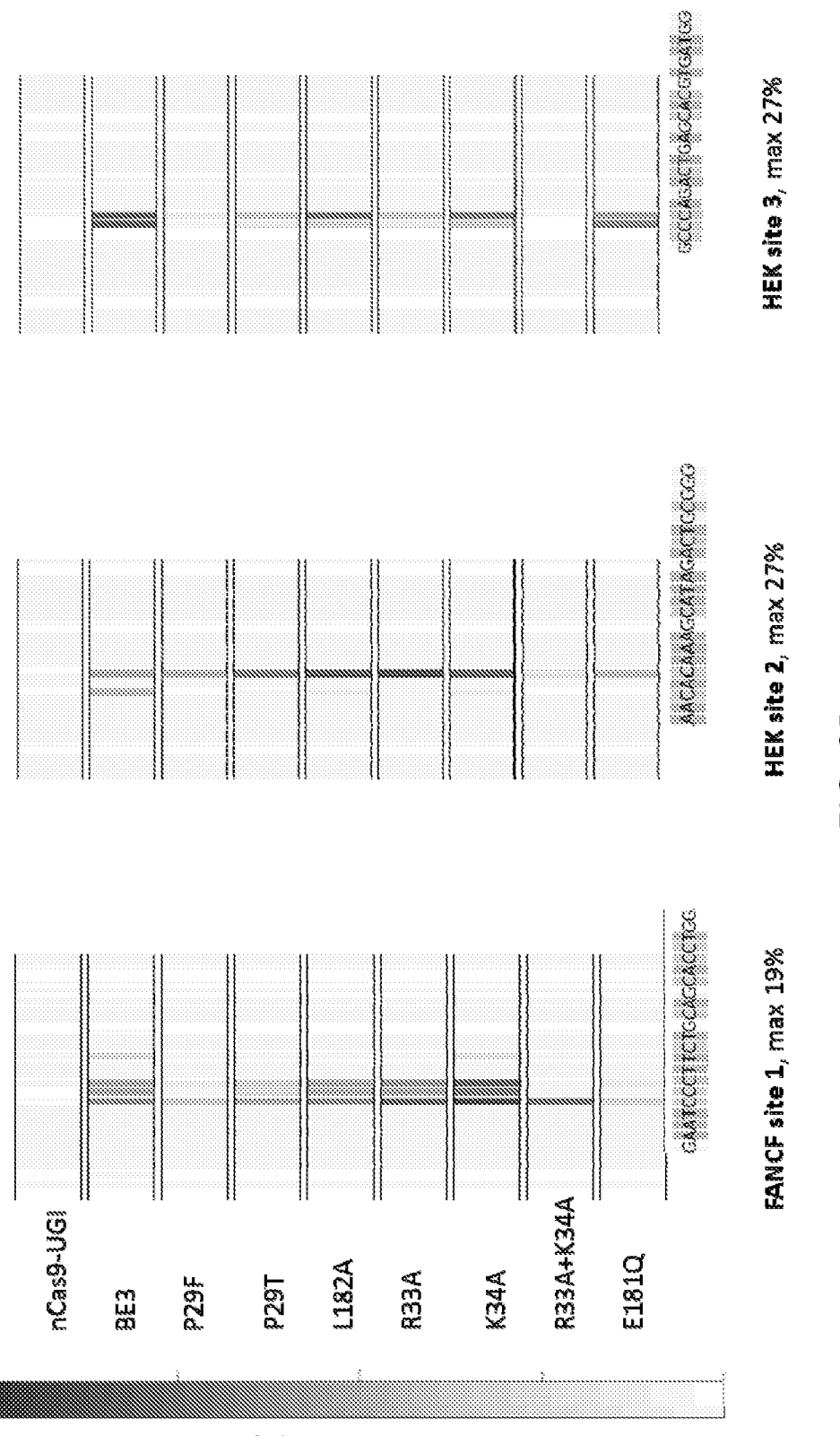
Figure 9C:
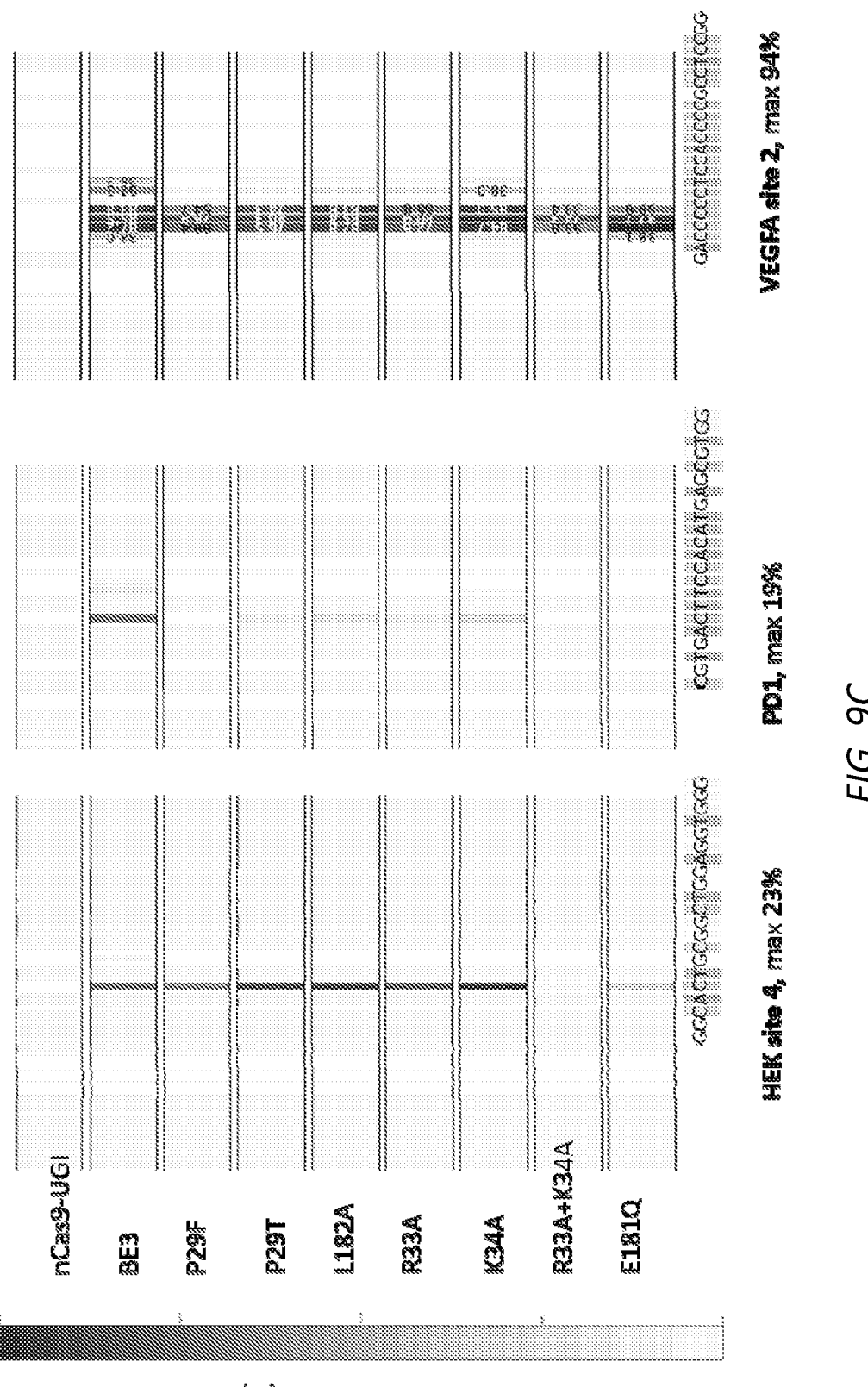
Figure 9D:
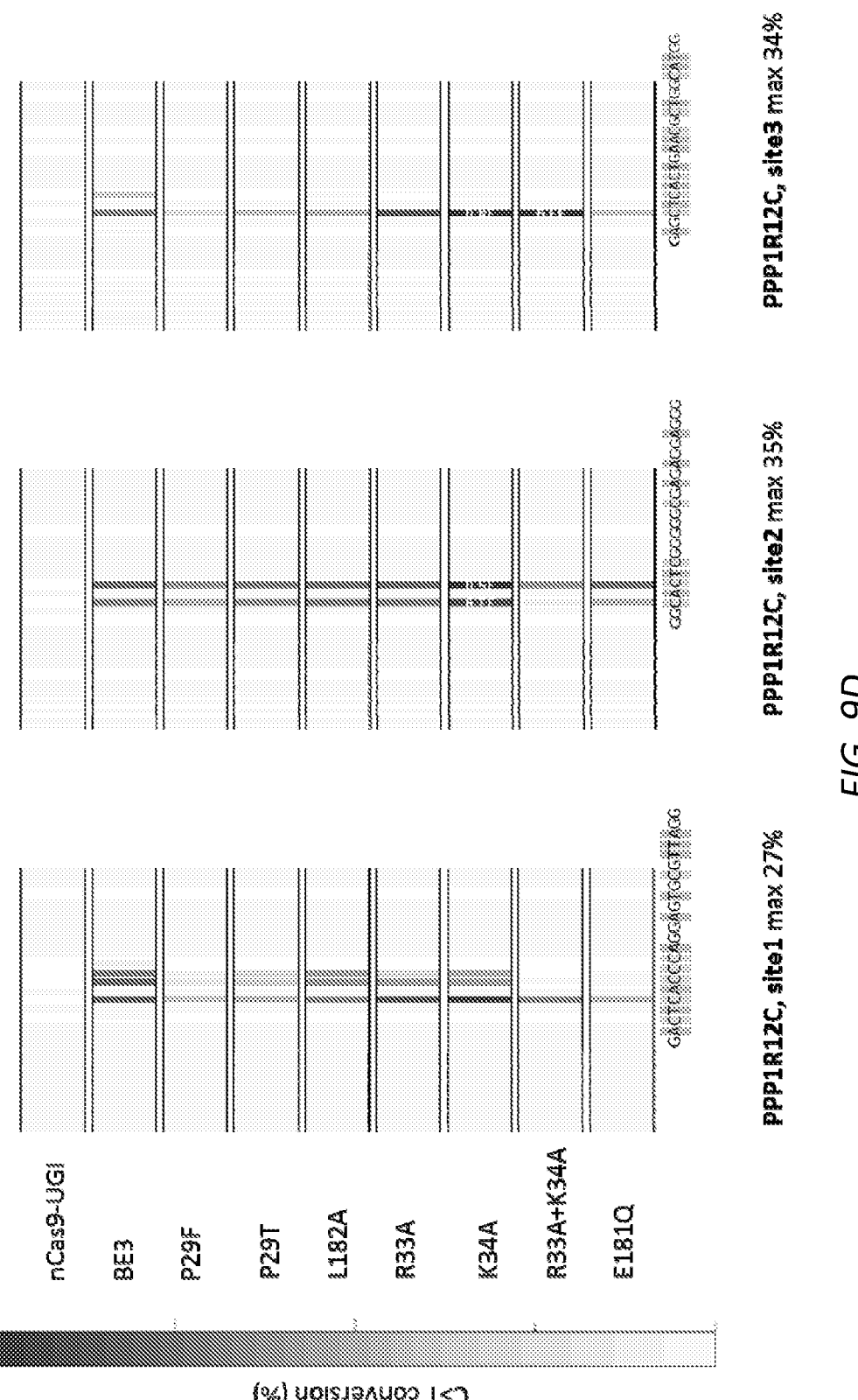

List of disease-associated gene variants that could be base-edited
therapeutically with an NGG PAM positioned appropriately
(taken from Komor et al, Nature 2016, Suppl. FIG. 8)

Information for each gene variant, from left to right:
  1.  dbSNP identification number 2.  genotype (written as the NCBI GenBank identification number of
      the gene, the gene name, the chromosome location and DNA base
      substitution of the SNP, and the amino acid substitution caused
      by the SNP)

3.  Cas9 protospacer and PAM sequence(s) to use with Cas9-based BEs
      (shown as the coding strand sequence)

4.  associated genetic disease

The activity window was expected to be at protospacer positions 4-8.
SNVs that lack bystander cytosines within the activity window are
highlighted in yellow. Cas9 and Cas12a variants with different PAM
specificities as well as zincfinger or TALE fusions might yield even
more targetable diseases.

| dbSNP # | Genotype | Protospacer and PAM sequence(s) | # | Associated genetic disease |
|---|---|---|---|---|
| 755445790 | NM_000391.3(TPP1): c.887-10A>G | TTTYTTTTTTTTTTTTTTTGAGG | 147 | Ceroid lipofuscinosis, neuronal, 2 |
| 113994167 | NM_000018.3 (ACADVL):c.848T>C (p.Val283Ala) | TTTGYGGTGGAGAGGGGCTTCGG, TTGYGGTGGAGAGGGGCTTCGGG | 148 149 | Very long chain acyl-CoA dehydrogenase deficiency |
| 119470018 | NM_024996.5(GFM1): c.521A>G (p.Asn174Ser) | TTGYTAATAAAAGTTAGAAACGG | 150 | Combined oxidative phosphorylation deficiency 1 |
| 115650537 | NM_000426.3 (LAMA2):c.8282T>C (p.Ile2761Thr) | TTGAYAGGGAGCAAGCAGTTCGG, TGAYAGGGAGCAAGCAGTTCGGG | 151 152 | Merosin deficient congenital muscular dystrophy |
| 587777752 | NM_014946.3 (SPAST): c.1688-2A>G | TTCYGTAAAACATAAAAGTCAGG | 153 | Spastic paraplegia 4, autosomal dominant |
| 794726821 | NM_001165963.1 (SCN1A):c.4055T>C (p.Leu1352Pro) | TTCYGGTTTGTCTTATATTCTGG | 154 | Severe myoclonic epilepsy in infancy |

TABLE E-continued

List of disease-associated gene variants that could be base-edited
therapeutically with an NGG PAM positioned appropriately
(taken from Komor et al, Nature 2016, Suppl. FIG. 8)

| 397514745 | NM_001130089.1 (KARS):c.517T>C (p.Tyr173His) | CTTCYATGATCTTCGAGGAGAGG, TTCYATGATCTTCGAGGAGAGGG | 155 156 | Deafness, autosomal recessive 89 |
|---|---|---|---|---|
| 376960358 | NM_001202.3(BMP4): c.362A>G (p.His121Arg) | TTCGTGGYGGAAGCTCCTCACGG | 157 | Microphthalmia syndromic 6 |
| 606231280 | NM_001287223.1 (SCN11A):c.1142T>C (p.Ile381Thr) | CTTCAYTGTGGTCATTTTCCTGG, TTCAYTGTGGTCATTTTCCTGGG | 158 159 | Episodic pain syndrome, familial, 3 |
| 387906735 | m.608A>G | TTCAGYGTATTGCTTTGAGGAGG | 160 | |
| 199474663 | m.3260A>G | TTAAGTTYTATGCGATTACCGGG | 161 | Cardiomyopathy with or without skeletal myopathy |
| 104894962 | NM_003413.3(ZIC3): c.1213A>G (p.Lys405Glu) | TGTGTTYGCGCAGGGAGCTCGGG, ATGTGTTYGCGCAGGGAGCTCGG | 162 163 | Heterotaxy, visceral, X-linked |
| 796053181 | NM_021007.2 (SCN2A):c.1271T>C (p.Val424Ala) | TGTGGYGGCCATGGCCTATGAGG | 164 | not provided |
| 267606788 | NM_000129.3(F13A1): c.728T>C (p.Met243Thr) | TGTGAYGGACAGAGCACAAATGG | 165 | Factor xiii, a subunit, deficiency of |
| 397514503 | NM_003863.3(DPM2): c.68A>G (p.Tyr23Cys) | TGTAGYAGGTGAAGATGATCAGG | 166 | Congenital disorder of glycosylation type 1u |
| 104893973 | NM_000416.2 (IFNGR1):c.260T>C (p.Ile87Thr) | TGTAATAYTTCTGATCATGTTGG | 167 | Disseminated atypical mycobacterial infection, Mycobacterium tuberculosis, susceptibility to |
| 121908466 | NM_005682.6 (ADGRG1):c.263A>G (p.Tyr88Cys) | TGGYAGAGGCCCCTGGGGTCAGG | 168 | Polymicrogyria, bilateral frontoparietal |
| 147952488 | NM_002437.4 (MPV17): c.186 + 2T>C | TGGYAAGTTCTCCCCTCAACAGG | 169 | Navajo neurohepatopathy |
| 121909537 | NM_001145.4(ANG): c.121A>G (p.Lys41Glu) | TGGTTYGGCATCATAGTGCTGGG, GTGGTTYGGCATCATAGTGCTGG | 170 171 | Amyotrophic lateral sclerosis type 9 |
| 121918489 | NM_000141.4 (FGFR2):c.1018T>C (p.Tyr340His) | TGGGGAAYATACGTGCTTGGCGG, GGGGAAYATACGTGCTTGGCGGG | 172 173 | Crouzon syndrome |
| 121434463 | m.12320A>G | GAGTYGCACCAAAATTTTTGGGG, GGAGTYGCACCAAAATTTTTGGG, TGGAGTYGCACCAAAATTTTTGG | 174 175 176 | Mitochondrial myopathy |
| 121908046 | NM_000403.3(GALE): c.101A>G (p.Asn34Ser) | TGGAAGYTATCGATGACCACAGG | 177 | UDPglucose-4- epimerase deficiency |
| 431905512 | NM_003764.3 (STX11):c.173T>C (p.Leu58Pro) | TGCYGGTGGCCGACGTGAAGCGG | 178 | Hemophagocytic lymphohistio- cytosis, familial 4 |
| 121917905 | NM_000124.3 (ERCC6):c.2960T>C (p.Leu987Pro) | TGCYAAAAGACCCAAAACAAAGG | 179 | Cerebro-oculo- facio-skeletal syndrome |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121918500 NM_000141.4<br>(FGFR2):c.874A>G<br>(p.Lys292Glu) | TGCTYGATCCACTGGATGTGGGG,<br>GTGCTYGATCCACTGGATGTGGG,<br>CGTGCTYGATCCACTGGATGTGG | 180<br>181<br>182 | Crouzon syndrome |
| 60431989 NM_000053.3<br>(ATP7B):c.3443T>C<br>(p.Ile1148Thr) | TGCTGAYTGGAAACCGTGAGTGG | 183 | Wilson disease |
| 78950939 NM_000250.1(MPO):<br>c.518A>G<br>(p.Tyr173Cys) | GTGCGGYATTTGTCCTGCTCCGG,<br>TGCGGYATTTGTCCTGCTCCGGG | 184<br>185 | Myeloperoxidase<br>deficiency |
| 115677373 NM_201631.3(TGM5):<br>c.763T>C<br>(p.Trp255Arg) | TGCGGAGYGGACGGGCAGCGTGG | 186 | Peeling skin<br>syndrome,<br>acral type |
| 5030804 NM000551.3(VHL):<br>c.233-A>G<br>(p.Asn78Ser) | GCGAYTGCAGAAGATGACCTGGG,<br>TGCGAYTGCAGAAGATGACCTGG | 187<br>188 | Von Hippel-Lindau<br>syndrome |
| 397508328 NM000492.3(CFTR):<br>c.1-A>G<br>(p.Met1Val) | GCAYGGTCTCTCGGGCGCTGGGG,<br>TGCAYGGTCTCTCGGGCGCTGGG,<br>CTGCAYGGTCTCTCGGGCGCTGG | 189<br>190<br>191 | Cystic fibrosis |
| 137853299 NM000362.4<br>(TIMP3):c.57-2A>G<br>(p.Tyr191Cys) | TGCAGYAGCCGCCCTTCTGCCGG | 192 | Sorsby fundus<br>dystrophy |
| 121908549 NM_000334.4<br>(SCN4A):c.3478A>G<br>(p.Ile1160Val) | TGAYGGAGGGGATGGCGCCTAGG | 193 | |
| 121909337 NM_001451.2<br>(FOXF1):c.1138T>C<br>(p.Ter380Arg) | TGATGYGAGGCTGCCGCCGCAGG | 194 | Alveolar capillary<br>dysplasia with<br>misalignment of<br>pulmonary veins |
| 281875320 NM_005359.5<br>(SMAD4):c.1500A>G<br>(p.Ile500Met) | TGAGYATGCATAAGCGACGAAGG | 195 | Myhre syndrome |
| 730880132 NM_170707.3(LMNA):<br>c.71-0T>C<br>(p.Phe237Ser) | TGAGTYTGAGAGCCGGCTGGCGG | 196 | Primary dilated<br>cardiomyopathy |
| 281875322 NM_005359.5<br>(SMAD-4):c.1498A>G<br>(p.Ile500Val) | TGAGTAYGCATAAGCGACGAAGG | 197 | Hereditary cancer-<br>predisposing<br>syndrome,<br>Myhre syndrome |
| 72556283 NM_000531.5(OTC):<br>c.527A>G<br>(p.Tyr176Cys) | TGAGGYAATCAGCCAGGATCTGG | 198 | not provided |
| 74315311 NM_020435.3(GJC2):<br>c.857T>C<br>(p.Met286Thr) | TGAGAYGGCCCACCTGGGCTTGG,<br>GAGAYGGCCCACCTGGGCTTGGG | 199<br>200 | Leukodystrophy,<br>hypomyelinating, 2 |
| 121912495 NM_170707.3(LMNA):<br>c.1139T>C<br>(p.Leu380Ser) | TCTYGGAGGGCGAGGAGGAGAGG | 201 | Congenital<br>muscular<br>dystrophy,<br>LMNA-related |
| 128620184 NM_000061.2(BTK):<br>c.1288A>G<br>(p.Lys430Glu) | TCTYGATGGCCACGTCGTACTGG | 202 | X-linked<br>agammaglobulinemia |
| 118192252 NM_004519.3(KCNQ3):<br>c.1403A>G<br>(p.Asn468Ser) | TCTTTAYTGTTTAAGCCAACAGG | 203 | Benign familial<br>neonatal seizures<br>2, not specified |
| 121909142 NM_001300.5(KLF6):<br>c.190T>C<br>(p.Trp64Arg) | TCTGYGGACCAAAATCATTCTGG | 204 | |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 104895503 | NM001127255.1 (NLRP7):c.2738A>G (p.Asn913Ser) | TCTGGYTGATACTCAAGTCCAGG | 205 | Hydatidiform mole |
| 587783035 | NM_000038.5(APC): c.1744-2A>G | TCCYAGTAAGAAACAGAATATGG | 206 | Familial adenomatous polyposis 1 |
| 72556289 | NM_000531.5(OTC): c.541-2A>G | TCCYAAAAGGCACGGGATGAAGG | 207 | not provided |
| 28937313 | NM_005502.3(ABCA1): c.2804A>G (p.Asn935Ser) | TCCAYTGTGGCCCAGGAAGGAGG, CGCTCCAYTGTGGCCCAGGAAGG | 208 209 | Tangier disease |
| 143246552 | NM_001003811.1 (TEX11):c.511A>G (p.Met171Val) | TCCAYGGTCAAGTCAGCCTCAGG, CCAYGGTCAAGTCAGCCTCAGGG | 210 211 | Spermatogenic failure, X-linked, 2 |
| 587776451 | NM_002049.3(GATA1): c.2T>C(p.Met1Thr) | CTCCAYGGAGTTCCCTGGCCTGG, TCCAYGGAGTTCCCTGGCCTGGG, CCAYGGAGTTCCCTGGCCTGGGG | 212 213 214 | GATA-1-related thrombocytopenia with dyserythropoiesis |
| 121908403 | NM_021102.3 (SPINT2):c.488A>G (p.Tyr163Cys) | TCCAYAGATGAAGTTATTGCAGG | 215 | Diarrhea 3, secretory sodium, congenital, syndromic |
| 281874738 | NM_000495.4(COL4A5): c.438 + 2T>C | CTCCAGYAAGTTATAAAATTTGG, TCCAGYAAGTTATAAAATTTGGG | 216 217 | Alport syndrome, X-linked recessive |
| 730880279 | NM_030653.3(DDX11): c.2271 + 2T>C | TCCAGGYGCGGGCGTCATGCTGG, CCAGGYGCGGGCGTCATGCTGGG | 218 219 | Warsaw breakage syndrome |
| 28940272 | NM_017890.4(VPS13B): c.8978A>G (p.Asn2993Ser) | TCAYTGATAAGCAGGGCCCAGGG, TTCAYTGATAAGCAGGGCCCAGG | 220 221 | Cohen syndrome, not specified |
| 137852375 | NM_000132.3(F8): c.5372T>C (p.Met1791Thr) | TCAYGGTGAGTTAAGGACAGTGG | 222 | Hereditary factor VIII deficiency disease |
| 11567847 | NM_021961.5(TEAD1): c.1261T>C (p.Tyr?His) | TCATATTYACAGGCTTGTAAAGG | 223 | |
| 786203989 | NM_016069.9(PAM16): c.226A>G (p.Asn76Asp) | CATAGTYCTGCAGAGGAGAGGGG, TCATAGTYCTGCAGAGGAGAGGG | 224 225 | Chondrodysplasia, megarbane-dagher-melki type |
| 587776437 | NC_012920.1:m.9478 T>C | TCAGAAGYTTTTTCTTCGCAGG | 226 | Leigh disease |
| 121912474 | NM_000424.3(KRT5): c.20T>C(p.Val7Ala) | TCAAGTGYGTCCTTCCGGAGCGG, CAAGTGYGTCCTTCCGGAGCGGG, AAGTGYGTCCTTCCGGAGCGGGG, AGTGYGTCCTTCCGGAGCGGGGG | 227 228 229 230 | Epidermolysis bullosa simplex, Koebner type |
| 104886461 | NM_020533.2 (MCOLN1):c.406-2A>G | TACYGTGGGCAGAGAAGGGAGG, AGGTACYGTGGGCAGAGAAGGGG, CAGGTACYGTGGGCAGAGAAGGG | 231 232 233 | Ganglioside sialidase deficiency |
| 104894275 | NM_000317.2(PTS): c.155A>G(p.Asn52Ser) | TAAYTGTGCCCATGGCCATTTGG | 234 | 6-pyruvoyl-tetrahydropterin synthase deficiency |
| 587777562 | NM_015599.2(PGM3): c.737A>G (p.Asn246Ser) | TAAATGAYTGAGTTTGCCCTTGG | 235 | Immunodeficiency 23 |
| 121964906 | NM_000027.3(AGA): c.916T>C (p.Cys306Arg) | GTTATAYGTGCCAATGTGACTGG | 236 | Aspartylglyco-saminuria |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 28941769 | NM_000356.3(TCOF1):<br>c.149A>G<br>(p.Tyr50Cys) | GTGTGTAYAGATGTCCAGAAGGG | 237 | Treacher collins<br>syndrome 1 |
| 121434464 | m.12297T>C | GTCYTAGGCCCCAAAAATTTTGG | 238 | Cardiomyopathy,<br>mitochondrial |
| 121908407 | NM_054027.4(ANKH):<br>c.143T>C<br>(p.Met48Thr) | GTCGAGAYGCTGGCCAGCTACGG,<br>TCGAGAYGCTGGCCAGCTACGGG | 239<br>240 | Chondrocalcinosis<br>2 |
| 59151893 | NM_000422.2(KRT17):<br>c.275A>G<br>(p.Asn92Ser) | GTCAYTGAGGTTCTGCATGGTGG,<br>GCGGTCAYTGAGGTTCTGCATGG | 241<br>242 | Pachyonychia<br>congenita<br>type 2 |
| 121909499 | NM_002427.3(MMP13):<br>c.272T>C<br>(p.Met91Thr) | GTCAYGAAAAAGCCAAGATGCGG,<br>TCAYGAAAAAGCCAAGATGCGGG | 243<br>244 | |
| 61748478 | NM_000552.3(VWF):<br>c.2384A>G<br>(p.Tyr795Cys) | GTCAYAGTTCTGGCACGTTTTGG | 245 | von Willebrand<br>disease type 2N |
| 387906889 | NM_006796.2(AFG3L2):<br>c.1847A>G<br>(p.Tyr616Cys) | GTAYAGAGGTATTGTTCTTTTGG | 246 | Spastic ataxia 5,<br>autosomal<br>recessive |
| 118203907 | NM_000130.4(F5):<br>c.5189A>G<br>(p.Tyr1730Cys) | GTAGYAGGCCCAAGCCCGACAGG | 247 | Factor V<br>deficiency |
| 118203945 | NM_013319.2(UBIAD1):<br>c.305A>G<br>(p.Asn102Ser) | GTAAGTGYTGACCAAATTACCGG | 248 | Schnyder<br>crystalline<br>corneal dystrophy |
| 267607080 | NM_005633.3(SOS1):<br>c.1294T>C<br>(p.Trp432Arg) | GGTYGGGAGGGAAAAGACATTGG | 249 | Noonan syndrome 4,<br>Rasopathy |
| 137852953 | NM_012464.4(TLL1):<br>c.1885A>G<br>(p.Ile629Val) | GGTTAYGGTGCCGTTAAGTTTGG | 250 | Atrial septal<br>defect 6 |
| 118203949 | NM_013319.2<br>(UBIAD1):c.695A>G<br>(p.Asn232Ser) | GGTGTTGYTGGAATGGAGAATGG | 251 | Schnyder<br>crystalline<br>corneal dystrophy |
| 137852952 | NM_012464.4(TLL1):<br>c.713T>C<br>(p.Val238Ala) | GGGATTGYTGTTCATGAATTGGG | 252 | Atrial septal<br>defect 6 |
| 41460449 | m.3394T>C | GGCYATATACAACTACGCAAAGG | 253 | Leber optic<br>atrophy |
| 80357281 | NM_007294.3<br>(BRCA1):c.5291T>C<br>(p.Leu1764Pro) | GGGCYAGAAATCTGTTGCTATGG,<br>GGCYAGAAATCTGTTGCTATGGG | 254<br>255 | Familial cancer<br>of breast,<br>Breast-ovarian<br>cancer,<br>familial 1 |
| 5030764 | NM_000174.4(GP9):<br>c.182A>G<br>(p.Asn61Ser) | GGCTGYTGTTGGCCAGCAGAAGG | 256 | Bernard-Soulier<br>syndrome type C |
| 72556282 | NM_000531.5(OTC):<br>c.526T>C<br>(p.Tyr176His) | GGCTGATYACCTCACGCTCCAGG,<br>GATYACCTCACGCTCCAGGTTGG | 257<br>258 | not provided |
| 121913594 | NM_000530.6(MPZ):<br>c.242A>G<br>(p.His81Arg) | GGCATAGYGGAAGATCTATGAGG | 259 | Charcot-Marie-<br>Tooth disease<br>type 1B |
| 587777736 | NM_017617.3<br>(NOTCH1):c.1285T>C<br>(p.Cys429Arg) | GGCAAGYGCATCAACACGCTGGG,<br>GGGCAAGYGCATCAACACGCTGG | 260<br>261 | Adams-Oliver<br>syndrome 1,<br>Adams-Oliver<br>syndrome 5 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 63750912 | NM_016835.4(MAPT): c.1839T>C (p.Asn613=) | GGATAAYATCAAACACGTCCCGG, GATAAYATCAAACACGTCCCGGG | 262 263 | Frontotemporal dementia |
| 121918075 | NM_000371.3(TTR): c.401A>G (p.Tyr134Cys) | GGAGYAGGGGCTCAGCAGGGCGG, ATAGGAGYAGGGGCTCAGCAGGG | 264 265 | Amyloidogenic transthyretin amyloidosis |
| 730882063 | NM_004523.3(KIF11): c.2547 + 2T>C | GGAGGYAATAACTTTGTAAGTGG | 266 | Microcephaly with or without chorioretinopathy, lymphedema, or mental retardation |
| 397516156 | NM_000257.3(MYH7): c.2546T>C (p.Met849Thr) | GGAGAYGGCCTCCATGAAGGAGG | 267 | Primary familial hypertrophic cardiomyopathy, Cardiomyopathy |
| 118204430 | NM_000035.3(ALDOB): c.442T>C (p.Trp148Arg) | GGAAGYGGCGTGCTGTGCTGAGG | 268 | Hereditary fructosuria |
| 200198778 | NM_013382.5(POMT2): c.1997A>G (p.Tyr666Cys) | GGAAGYAGTGGTGGAAGTAGAGG | 269 | Congenital muscular dystrophy, Congenital muscular dystrophy-dystroglycanopathy with brain and eye nomalies, type A2, Muscular dystrophy, Congenital muscular dystrophy-dystroglycanopathy with mental retardation, type B2 |
| 754896795 | NM_004006.2(DMD): c.6982A>T (p.Lys2328Ter) | GCTTTTYTTCAAGCTGCCCAAGG | 270 | Duchenne muscular dystrophy, Becker muscular dystrophy, Dilated cardiomyopathy 3B |
| 148924904 | NM_000546.5(TP53): c.488A>G (p.Tyr163Cys) | GCTTGYAGATGGCCATGGCGCGG | 271 | Hereditary cancer-predisposing syndrome |
| 786204770 | NM_016035.4(COQ4): c.155T>C (p.Leu52Ser) | GCTGTYGGCCGCCGGCTCCGCGG | 272 | COENZYME Q10 DEFICIENCY, PRIMARY, 7 |
| 121909520 | NM_001100.3(ACTA1): c.350A>G (p.Asn117Ser) | CGGYTGGCCTTGGGATTGAGGGG, GCGGYTGGCCTTGGGATTGAGGG, CGCGGYTGGCCTTGGGATTGAGG | 273 274 275 | Nemaline myopathy 3 |
| 587776879 | NM_004656.3(BAP1): c.438-2A>G | GCCYGGGGAAAAACAGAGTCAGG | 276 | Tumor predisposition syndrome |
| 727504434 | NM_000501.3(ELN): c.890-2A>G | GCCYGAAAACACAGCCACAGAGG | 277 | Supravalvar aortic stenosis |
| 119455953 | NM_000391.3(TPP1): c.1093T>C (p.Cys365Arg) | GCCGGGYGTTGGTCTGTCTCTGG | 278 | Ceroid lipofuscinosis, neuronal, 2 |
| 121964983 | NM_000481.3(AMT): c.125A>G (p.His42Arg) | GCCAGGYGGAAGTCATAGAGCGG | 279 | Non-ketotic hyperglycinemia |
| 121908300 | NM_001005741.2 (GBA):c.751T>C (p.Tyr251His) | GCCAGAYACTTTGTGAAGTAAGG, CCAGAYACTTTGTGAAGTAAGGG | 280 281 | Gaucher disease, type 1 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 786205083 | NM_003494.3 (DYSF): c.3443-33A>G | GCCAGAGYGAGTGGCTGGAGTGG | 282 | Limb-girdle muscular dystrophy, type 2B |
| 121908133 | NM_175073.2 (APTX): c.602A>G (p.His201Arg) | GCCAAYGGTAACGGGCCTTTGGG, AGCCAAYGGTAACGGGCCTTTGG | 283 284 | Adult onset ataxia with oculomotor apraxia |
| 587777195 | NM_005017.3 (PCYT1A):c.571T>C (p.Phe191Leu) | GCATGYTTGCTCCAACACAGAGG | 285 | Spondylometaphyseal dysplasia with cone-rod dystrophy |
| 431905520 | NM_014714.3 (IFT140):c.4078T>C (p.Cys1360Arg) | CAAGCAGYGTGAGCTGCTCCTGG, GCAGYGTGAGCTGCTCCTGGAGG | 286 287 | Renal dysplasia, retinal pigmentary dystrophy, cerebellar ataxia and skeletal dysplasia |
| 121912889 | NM_001844.4 (COL2A1):c.4172A>G (p.Tyr1391Cys) | GCAGTGGYAGGTGATGTTCTGGG | 288 | Spondyloperipheral dysplasia, Platyspondylic lethal skeletal dysplasia Torrance type |
| 137854492 | NM_001363.4 (DKC1): c.1069A>G (p.Thr357Ala) | GCAGGYAGAGATGACCGCTGTGG | 289 | Dyskeratosis congenita X-linked |
| 121434362 | NM_152783.4 (D2HGDH):c.1315A>G (p.Asn439Asp) | GCAGGTYACCATCTCCTGGAGGG, TGCAGGTYACCATCTCCTGGAGG | 290 291 | D-2-hydroxyglutaric aciduria 1 |
| 80338732 | NM_002764.3 (PRPS1): c.344T>C (p.Met115Thr) | GCAAATAYGCTATCTGTAGCAGG | 292 | Charcot-Marie-Tooth disease, X-linked recessive, type 5 |
| 387906675 | NM_000313.3 (PROS1) :c.701A>G (p.Tyr234Cys) | GATTAYATCTGTAGCCTTCGGGG, AGATTAYATCTGTAGCCTTCGGG, GAGATTAYATCTGTAGCCTTCGG | 293 294 295 | Thrombophilia due to protein S deficiency, autosomal recessive |
| 28935478 | NM_000061.2 (BTK): c.1082A>G (p.Tyr361Cys) | GATGGYAGTTAATGAGCTCAGGG, TGATGGYAGTTAATGAGCTCAGG | 296 297 | |
| 201777056 | NM_005050.3 (ABCD4):c.956A>G (p.Tyr319Cys) | GATGAGGYAGATGCACACAAAGG | 298 | METHYLMALONIC ACIDURIA AND HOMOCYSTINURIA, cbIJ TYPE |
| 121918528 | NM_000098.2 (CPT2): c.359A>G (p.Tyr120Cys) | GATAGGYACATATCAAACCAGGG, AGATAGGYACATATCAAACCAGG | 299 300 | Carnitine palmitoyltransferase II deficiency, infantile |
| 267607014 | NM_002942.4 (ROBO2): c.2834T>C (p.Ile945Thr) | GAGAYTGGAAATTTTGGCCGTGG | 301 | Vesicoureteral reflux 2 |
| 281865192 | NM_025114.3 (CEP290):c.2991 + 1655A>G | GATAYTCACAATTACAACTGGGG, AGATAYTCACAATTACAACTGGG, GAGATAYTCACAATTACAACTGG | 302 303 304 | Leber congenital amaurosis 10 |
| 386833492 | NM_000112.3 (SLC26A2):c.-26 + 2T>C | GAGAGGYGAGAAGAGGGAAGCGG | 305 | Diastrophic dysplasia |
| 587779773 | NM_001101.3 (ACTB): c.356T>C (p.Met119Thr) | GAGAAGAYGACCCAGGTGAGTGG | 306 | Baraitser-Winter syndrome 1 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121913512 | NM_000222.2(KIT):<br>c.1924A>G<br>(p.Lys642Glu) | GACTTYGAGTTCAGACATGAGGG,<br>GGACTTYGAGTTCAGACATGAGG | 307<br>308 | |
| 28939072 | NM_006329.3(FBLN5):<br>c.506T>C<br>(p.Ile169Thr) | GACAYTGATGAATGTCGCTATGG | 309 | Age-related macular<br>degeneration 3 |
| 104894248 | NM_000525.3(KCNJ11):<br>c.776A>G<br>(p.His259Arg) | GACAYGGTAGATGATCAGCGGGG,<br>TGACAYGGTAGATGATCAGCGGG,<br>ATGACAYGGTAGATGATCAGCGG | 310<br>311<br>312 | Islet cell<br>hyperplasia |
| 387907132 | NM_016464.4(TMEM138):<br>c.287A>G<br>(p.His96Arg) | GACAYGAAGGGAGATGCTGAGGG,<br>AGACAYGAAGGGAGATGCTGAGG | 313<br>314 | Joubert syndrome 16 |
| 121918170 | NM_000275.2(OCA2):<br>c.1465A>G<br>(p.Asn489Asp) | GACATYTGGAGGGTCCCCGATGG | 315 | Tyrosinase-positive<br>oculocutaneous<br>albinism |
| 122467173 | NM_014009.3(FOXP3):<br>c.970T>C<br>(p.Phe324Leu) | GACAGAGYTCCTCCACAACATGG | 316 | Insulin-dependent<br>diabetes mellitus<br>secretory diarrhea<br>syndrome |
| 137852268 | NM000133.3(F9):<br>c.1328T>C<br>(p.Ile443Thr) | GAAYATATACCAAGGTATCCCGG | 317 | Hereditary<br>factor IX<br>deficiency disease |
| 149054177 | NM_001999.3(FBN2):<br>c.3740T>C<br>(p.Met1247Thr) | GAATGTAYGATAATGAACGGAGG | 318 | not specified,<br>Macular<br>degeneration,<br>early onset |
| 137854488 | NM_212482.1(FN1):<br>c.2918A>G<br>(p.Tyr973Cys) | GAAGTAAYAGGTGACCCCAGGGG | 319 | Glomerulopathy<br>with fibronectin<br>deposits 2 |
| 786204027 | NM005957.4(MTHFR):<br>c.1530 + 2T>C | GAAGGYGTGGTAGGGAGGCACGG,<br>AAGGYGTGGTAGGGAGGCACGG,<br>AGGYGTGGTAGGGAGGCACGGGG | 320<br>321<br>322 | Homocysteinemia<br>due to MTHFR<br>deficiency |
| 104894223 | NM_012193.3(F2D4):<br>c.766A>G<br>(p.Ile256Val) | GAAATAYGATGGGGCGCTCAGGG,<br>AGAAATAYGATGGGGCGCTCAGG | 323<br>324 | Retinopathy of<br>prematurity |
| 137854474 | NM_000138.4(FBN1):<br>c.3793T>C<br>(p.Cys1265Arg) | CTTGYGTTATGATGGATTCATGG | 325 | Marfan syndrome |
| 587784418 | NM_006306.3(SMC1A):<br>c.3254A>G<br>(p.Tyr1085Cys) | CTTAYAGATCTCATCAATGTTGG | 326 | Congenital muscular<br>hypertrophy-<br>cerebral syndrome |
| 81002805 | NM_000059.3(BRCA2):<br>c.316 + 2T>C | CTTAGGYAAGTAATGCAATATGG | 327 | Familial cancer of<br>breast, Breast-<br>ovarian cancer,<br>familial 2,<br>Hereditary cancer<br>predisposing<br>syndrome |
| 121909653 | NM_182925.4(FLT4):<br>c.3104A>G<br>(p.His1035Arg) | CTGYGGATGCACTGGGGTGCGGG,<br>TCTGYGGATGCACTGGGGTGCGG | 328<br>329 | |
| 786205107 | NM_031226.2(CYP19A1):<br>c.743 + 2T>C | CTGTGYAAGTAATACAACTTTGG | 330 | Aromatase<br>deficiency |
| 587777037 | NM_001283009.1(RTEL1):<br>c.3730T>C<br>(p.Cys1244Arg) | CTGTGTGYGCCAGGGCTGTGGGG | 331 | Dyskeratosis<br>congenita,<br>autosomal<br>recessive, 5 |

TABLE E-continued

| | | | |
|---|---|---|---|
| \multicolumn{4}{c}{List of disease-associated gene variants that could be base-edited therapeutically with an NGG PAM positioned appropriately (taken from Komor et al, Nature 2016, Suppl. FIG. 8)} |

| 794728380 | NM_000238.3(KCNH2): c.1945 + 6T>C | CTGTGAGYGTGCCCAGGGGCGGG, TGAGYGTGCCCAGGGGCGGGCGG | 332 333 | Cardiac arrhythmia |
|---|---|---|---|---|
| 267607987 | NM_000251.2(MSH2): c.2005 + 2T>C | CTGGYAAAAAACCTGGTTTTTGG, TGGYAAAAAACCTGGTTTTTGGG | 334 335 | Hereditary Nonpolyposis Colorectal Neoplasms |
| 397509397 | NM_006876.2(B4GAT1): c.1168A>G (p.Asn390Asp) | TGATYTTCAGCCTCCTTTTGGGG, CTGATYTTCAGCCTCCTTTTGGG, GCTGATYTTCAGCCTCCTTTTGG | 336 337 338 | Congenital muscular dystrophydystrogly- canopathy with brain and eye anomalies, type A13 |
| 121918381 | NM_000040.1(APOC3): c.280A>G (p.Thr94Ala) | CTGAAGYTGGTCTGACCTCAGGG, GCTGAAGYTGGTCTGACCTCAGG | 339 340 | |
| 104894919 | NM_001015877.1(PHF6): c.769A>G (p.Arg257Gly) | CTCYTGATGTTGTTGTGAGCTGG | 341 | Borjeson-Forssman- Lehmann syndrome |
| 267606869 | NM_005144.4(HR): c.218A>G | CTCYAGGGCCGCAGGTTGGAGGG, GCTCYAGGGCCGCAGGTTGGAGG, GGCGCTCYAGGGCCGCAGGTTGG | 342 343 344 | Marie Unna hereditary hypotrichosis 1 |
| 139732572 | NM_000146.3(FTL): c.1A>G(p.Met1Val) | CTCAYGGTTGGTTGGCAAGAAGG | 345 | L-ferritin deficiency |
| 397515418 | NM_018486.2 (HDAC8):c.1001A>G (p.His334Arg) | CTCAYGATCTGGGATCTCAGAGG | 346 | Cornelia de Lange syndrome 5 |
| 372395294 | NM_198056.2(SCN5A): c.1247A>G (p.Tyr416Cys) | CTCAYAGGCCATTGCGACCACGG | 347 | not provided |
| 104895304 | NM_000431.3(MVK): c.803T>C (p.Ile268Thr) | CTCAAYAGATGCCATCTCCCTGG | 348 | Hyperimmunoglobulin D with periodic fever, Mevalonic aciduria |
| 587777188 | NM_001165899.1 (PDE4D):c.1850T>C (p.Ile617Thr) | CTATAYTGTTCATCCCCTCTGGG, ACTATAYTGTTCATCCCCTCTGG | 349 350 | Acrodysostosis 2, with or without hormone resistance |
| 398123026 | NM_003867.3(FGF17): c.560A>G (p.Asn187Ser) | CGTGGYTGGGGAAGGGCAGCTGG | 351 | Hypogonadotropic hypogonadism 20 with or without anosmia |
| 121964924 | NM_001385.2(DPYS): c.1078T>C (p.Trp360Arg) | CGTAATAYGGGAAAAAGGCGTGG, AATAYGGGAAAAAGGCGTGGTGG, ATAYGGGAAAAAGGCGTGGTGGG | 352 353 354 | Dihydropyrimidinase deficiency |
| 587777301 | NM_199189.2(MATR3): c.1864A>G (p.Thr622Ala) | CGGYTGAACTCTCAGTCTTCTGG | 355 | Myopathy, distal, 2 |
| 200238879 | NM-000527.4(LDLR): c.694 + 2T>C | ACTGCGGYATGGGCGGGGCCAGG, CTGCGGYATGGGCGGGGCCAGGG, CGGYATGGGCGGGGCCAGGGTGG | 356 357 358 | Familial hypercholesterolemia |
| 142951029 | NM_145046.4(CALR3): c.245A>G (p.Lys82Arg) | CGGTYTGAAGCGTGCAGAGATGG | 359 | Arrhythmogenic right ventricular cardiomyopathy, Familial hypertrophic cardiomyopathy 19, Hypertrophic cardiomyopathy |
| 786200953 | NM_006785.3(MALT1): c.1019-2A>G | CGCYTTGAAAAAAAAAGAAAGGG, TCGCYTTGAAAAAAAAAGAAAGG | 360 361 | Combined immunodeficiency |

TABLE E-continued

| List of disease-associated gene variants that could be base-edited therapeutically with an NGG PAM positioned appropriately (taken from Komor et al, Nature 2016, Suppl. FIG. 8) | | | |
|---|---|---|---|
| 120074192 NM_000218.2 (KCNQ1): c.418A>G (p.Ser140Gly) | CGCYGAAGATGAGGCAGACCAGG | 362 | Atrial fibrillation, familial, 3, Atrial fibrillation |
| 267606887 NM_005957.4 (MTHFR): c.971A>G (p.Asn324Ser) | CGCGGYTGAGGGTGTAGAAGTGG | 363 | Homocystinuria due to MTHFR deficiency |
| 118192117 NM_000540.2 (RYR1): c.1205T>C (p.Met402Thr) | CGCAYGATCCACAGCACCAATGG | 364 | Congenital myopathy with fiber type disproportion, Central core disease |
| 199473625 NM_198056.2 (SCN5A): c.4978A>G (p.Ile1660Val) | CGAYGTTGAAGAGGGCAGGCAGG, AGCCCGAYGTTGAAGAGGGCAGG | 365 366 | Brugada syndrome |
| 794726865 NM_000921.4 (PDE3A): c.1333A>G (p.Thr445Ala) | CGAGGYGGTGGTGGTCCAAGTGG | 367 | Brachydactyly with hypertension |
| 606231254 NM_005740.2 (DNAL4): c.153 + 2T>C | CGAGGYATTGCCAGCAGTGCAGG | 368 | Mirror movements 3 |
| 786204826 NM_004771.3 (MMP20): c.611A>G (p.His204Arg) | CGAAAYGTGTATCTCCTCCCAGG | 369 | Amelogenesis imperfecta, hypomaturation type, IIA2 |
| 796053139 NM_021007.2 (SCN2A): c.4308 + 2T>C | CGAAATGYAAGTCTAGTTAGAGG, GAAATGYAAGTCTAGTTAGAGGG | 370 371 | not provided |
| 137854494 NM_005502.3 (ABCA1): c.4429T>C (p.Cys1477Arg) | CCTGTGYGTCCCCCAGGGGCAGG, CTGTGYGYGTCCCCCAGGGGCAGGG, TGTGYGTCCCCCAGGGGCAGGGG, GTGYGTCCCCCAGGGGCAGGGGG | 372 373 374 375 | Tangier disease |
| 786205144 NM_001103.3 (ACTN2): c.683T>C (p.Met228Thr) | CCTAAAAYGTTGGATGCTGAAGG | 376 | Dilated cardiomyopathy 1AA |
| 199919568 NM_007254.3 (PNKP): c.1029 + 2T>C | CCGGYGAGGCCCTGGGGCGGGGG, TCCGGYGAGGCCCTGGGGCGGGG, ATCCGGYGAGGCCCTGGGGCGGG, GATCCGGYGAGGCCCTGGGGCGG | 377 378 379 380 | not provided |
| 28939079 NM_018965.3 (TREM2): c.401A>G (p.Asp134Gly) | TGAYCCAGGGGGTCTATGGGAGG, CGGTGAYCCAGGGGGTCTATGGG, CCGGTGAYCCAGGGGGTCTATGG | 381 382 383 | Polycystic lipomembranous osteodysplasia with sclerosing leukoencephalopathy |
| 193302855 NM_032520.4 (GNPTG): c.610-2A>G | CCCYGAAGGTGGAGGATGCAGGG, GCCCYGAAGGTGGAGGATGCAGG | 384 385 | Mucolipidosis III Gamma |
| 111033708 NM_000155.3 (GALT): c.499T>C (p.Trp167Arg) | CCCTYGGGTGCAGGTTTGTGAGG | 386 | Deficiency of UDPglucose-hexose-1-phosphate uridylyltransferase |
| 28933378 NM_000174.4 (GP9): c.70T>C (p.Cys24Arg) | CCCAYGTACCTGCCGCGCCCTGG | 387 | Bernard Soulier syndrome, Bernard-Soulier syndrome type C |
| 364897 NM_000157.3 (GBA): c.680A>G (p.Asn227Ser) | CCAYTGGTCTTGAGCCAAGTGGG, TCCAYTGGTCTTGAGCCAAGTGG | 388 389 | Gaucher disease, Subacute neuronopathic Gaucher disease, Gaucher disease, type 1 |
| 796052551 NM_000833.4 (GRIN2A): c.2449A>G (p.Met817Val) | CCAYGTTGTCAATGTCCAGCTGG | 390 | not provided |

TABLE E-continued

| | | | |
|---|---|---|---|
| | List of disease-associated gene variants that could be base-edited therapeutically with an NGG PAM positioned appropriately (taken from Komor et al, Nature 2016, Suppl. FIG. 8) | | |

| | | | | |
|---|---|---|---|---|
| 63751006 | NM_002087.3(GRN): c.2T>C(p.Met1Thr) | CCAYGTGGACCCTGGTGAGCTGG | 391 | Frontotemporal dementia, ubiquitin-positive |
| 786203997 | NM_001031.4(RPS28): c.1A>G(p.Met1Val) | TGTCCAYGATGGCGGCGCGGCGG, CCAYGATGGCGGCGCGGCGGCGG | 392 393 | Diamond-Blackfan anemia with microtia and cleft palate |
| 121908595 | NM_002755.3(MAP2K1): c.389A>G (p.Tyr130Cys) | CCAYAGAAGCCCACGATGTACGG | 394 | Cardiofaciocutaneous syndrome 3, Rasopathy |
| 398122910 | NM_000431.3(MVK): c.1039 + 2T>C | CCAGGYATCCCGGGGGTAGGTGG, CAGGYATCCCGGGGGTAGGTGGG | 395 396 | Porokeratosis, disseminated superficial actinic 1 |
| 119474039 | NM_020365.4(EIF2B3): c.1037T>C (p.Ile346Thr) | CCAGAYTGTCAGCAAACACCTGG | 397 | Leukoencephalopathy with vanishing white matter |
| 587777866 | NM_000076.2(CDKN1C): c.*5 + 2T>C | CCAAGYGAGTACAGCGCACCTGG, CAAGYGAGTACAGCGCACCTGGG, AAGYGAGTACAGCGCACCTGGGG | 398 399 400 | Beckwith-Wiedemann syndrome |
| 121918530 | NM_005587.2(MEF2A): c.788A>G (p.Asn263Ser) | AGAYTACCACCACCTGGTGGAGG, CCAAGAYTACCACCACCTGGTGG | 401 402 | |
| 483352818 | NM_000211.4(ITGB2): c.1877 + 2T>C | CATGYGAGTGCAGGCGGAGCAGG | 403 | Leukocyte adhesion deficiency type 1 |
| 460184 | NM_000186.3(CFH): c.3590T>C (p.Val1197Ala) | CAGYTGAATTTGTGTGTAAACGG | 404 | Atypical hemolytic-uremic syndrome 1 |
| 121908423 | NM_004795.3(KL): c.578A>G (p.His193Arg) | CAGYGGTACAGGGTGACCACGGG, CCAGYGGTACAGGGTGACCACGG | 405 406 | |
| 281860300 | NM_005247.2(FGF3): c.146A>G (p.Tyr49Cys) | CAGYAGAGCTTGCGGCGCCGGGG, GCAGYAGAGCTTGCGGCGCCGGG, CGCAGYAGAGCTTGCGGCGCCGG | 407 408 409 | Deafness with labyrinthine aplasia microtia and microdontia (LAMM) |
| 28935488 | NM_000169.2(GLA): c.806T>C (p.Val269Ala) | CAGTTAGYGATTGGCAACTTTGG | 410 | Fabry disease |
| 587776514 | NM_173560.3(RFX6): c.380 + 2T>C | CAGTGGYGAGACTCGCCCGCAGG, AGTGGYGAGACTCGCCCGCAGGG | 411 412 | Mitchell-Riley syndrome |
| 104894117 | NM_178138.4(LHX3): c.332A>G (p.Tyr111Cys) | CAGGTGGYACACGAAGTCCTGGG | 413 | Pituitary hormone deficiency, combined 3 |
| 34878913 | NM_000184.2(HBG2): c.125T>C (p.Phe42Ser) | CAGAGGTYCTTTGACAGCTTTGG | 414 | Cyanosis, transient neonatal |
| 120074124 | NM_000543.4(SMPD1): c.911T>C (p.Leu304Pro) | AGCACYTGTGAGGAAGTTCCTGG, GCACYTGTGAGGAAGTTCCTGGG, CACYTGTGAGGAAGTTCCTGGGG | 415 416 417 | Sphingomyelin/cholesterol lipidosis, Niemann Pick disease, type A, Niemann-Pick disease, type B |
| 281860272 | NM_005211.3(CSF1R): c.2320-2A>G | CACYGAGGGAAAGCACTGCAGGG, GCACYGAGGGAAAGCACTGCAGG | 418 419 | Hereditary diffuse leukoencephalopathy with spheroids |
| 128624216 | NM_000033.3(ABCD1): c.443A>G (p.Asn148Ser) | CACTGYTGACGAAGGTAGCAGGG, GCACTGYTGACGAAGGTAGCAGG | 420 421 | Adrenoleukodystrophy |

TABLE E-continued

List of disease-associated gene variants that could be base-edited
therapeutically with an NGG PAM positioned appropriately
(taken from Komor et al, Nature 2016, Suppl. FIG. 8)

| 398124257 | NM_012463.3 (ATP6V0A2): c.825 + 2T>C | CACTGYGAGTAAGCTGGAAGTGG | 422 | Cutis laxa with osteodystrophy |
|---|---|---|---|---|
| 267606679 | NM_004183.3(BEST1): c.704T>C (p.Val235Ala) | CACTGGYGTATACACAGGTGAGG | 423 | Vitreoretinochoroido-pathy dominant |
| 397514518 | NM_000344.3(SMN1): c.388T>C (p.Tyr130His) | CACTGGAYATGGAAATAGAGAGG | 424 | Kugelberg-Welander disease |
| 143946794 | NM_001946.3(DUSP6): c.566A>G (p.Asn189Ser) | CACTAYTGGGGTCTCGGTCAAGG | 425 | Hypogonadotropic hypogonadism 19 with or without anosmia |
| 397516076 | NM_000256.3 (MYBPC3):c.821 + 2T>C | GCACGYGAGTGGCCATCCTCAGG, CACGYGAGTGGCCATCCTCAGGG | 426 427 | Familial hypertrophic cardiomyopathy 4, not specified |
| 149977726 | NM_001257988.1 (TYMP):c.665A>G (p.Lys222Arg) | CACGAGTYTCTTACTGAGAATGG, GAGTYTCTTACTGAGAATGGAGG | 428 429 | |
| 121917770 | NM_003361.3(UMOD): c.383A>G (p.Asn128Ser) | CACAYTGACACATGTGGCCAGGG, CCACAYTGACACATGTGGCCAGG | 430 431 | Familial juvenile gout |
| 121909008 | NM_000492.3(CFTR): c.2738A>G (p.Tyr913Cys) | CACATAAYACGAACTGGTGCTGG | 432 | Cystic fibrosis |
| 137852819 | NM_003688.3(CASK): c.2740T>C (p.Trp914Arg) | CACAGYGGGTCCCTGTCTCCTGG, ACAGYGGGTCCCTGTCTCCTGGG | 433 434 | FG syndrome 4 |
| 74315320 | NM_024009.2(GJB3): c.421A>G (p.Ile141Val) | CAAYGATGAGCTTGAAGATGAGG | 435 | Deafness, autosomal recessive |
| 80356747 | NM_001701.3(BAAT): c.967A>G (p.Ile323Val) | CAAYGAAGAGGAATTGCCCCTGG | 436 | Atypical hemolytic-uremic syndrome 1 |
| 180177324 | NM_012203.1(GRHPR): c.934A>G (p.Asn312Asp) | CAAGTYGTTAGCTGCCAACAAGG | 437 | Primary hyperoxaluria, type II |
| 281860274 | NM_005211.3(CSF1R): c.2381T>C (p.Ile794Thr) | CAAGAYTGGGGACTTCGGGCTGG | 438 | Hereditary diffuse leukoencephalopathy with spheroids |
| 398122908 | NM_005334.2(HCFC1): c.-970T>C | CAAGAYGGCGGCTCCCAGGGAGG | 439 | Mental retardation 3, X-linked |
| 548076633 | NM_002693.2(POLG): c.3470A>G (p.Asn1157Ser) | CAAGAGGYTGGTGATCTGCAAGG | 440 | not provided |
| 120074146 | NM_000019.3 (ACAT1):c.935T>C (p.Ile312Thr) | CAAGAAYAGTAGGTAAGGCCAGG | 441 | Deficiency of acetyl-CoA acetyltransferase |
| 397514489 | NM_005340.6(HINT1): c.250T>C (p.Cys84Arg) | CAAGAAAYGTGCTGCTGATCTGG, AAGAAAYGTGCTGCTGATCTGGG | 442 443 | Gamstorp-Wohlfart syndrome |
| 587783539 | NM_178151.2(DCX): c.2T>C(p.Met1Thr) | CAAAATAYGGAACTTGATTTTGG | 444 | Heterotopia |
| 104894765 | NM_005448.2(BMP15): c.704A>G (p.Tyr235Cys) | ATTGAAAYAGAGTAACAAGAAGG | 445 | Ovarian dysgenesis 2 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 137852429 | NM_000132.3(F8): c.1892A>G (p.Asn631Ser) | ATGYTGGAGGCTTGGAACTCTGG | 446 | Hereditary factor VIII deficiency disease |
| 72558441 | NM_000531.5(OTC): c.779T>C (p.Leu260Ser) | ATGTATYAATTACAGACACTTGG | 447 | not provided |
| 398123765 | NM_003494.3(DYSF): c.1284 + 2T>C | ATGGYAAGGAGCAAGGGAGCAGG | 448 | Limb-girdle muscular dystrophy, type 2B |
| 387906924 | NM_020191.2 (MRPS22):c.644T>C (p.Leu215Pro) | ATCYTAGGGTAAGGTGACTTAGG | 449 | Combined oxidative phosphorylation deficiency 5 |
| 397518039 | NM_206933.2(USH2A): c.8559-2A>G | ATCYAAAGCAAAAGACAAGCAGG | 450 | Retinitis pigmentosa, Usher syndrome, type 2A |
| 5742905 | NM_000071.2(CBS): c.833T>C (p.Ile278Thr) | ATCAYTGGGGTGGATCCCGAAGG, TCAYTGGGGTGGATCCCGAAGGG | 451 452 | Homocystinuria due to CBS deficiency, Homocystinuria, pyridoxine-responsive |
| 397507473 | NM_004333.4(BRAF): c.1403T>C (p.Phe468Ser) | ATCATYTGGAACAGTCTACAAGG, TCATYTGGAACAGTCTACAAGGG | 453 454 | Cardiofaciocutaneous syndrome, Rasopathy |
| 786204056 | NM_000264.3(PTCH1): c.3168 + 2T>C | ATCATTGYGAGTGTATTATAAGG, TCATTGYGAGTGTATTATAAGGG, CATTGYGAGTGTATTATAAGGGG | 455 456 457 | Gorlin syndrome |
| 72558484 | NM_000531.5(OTC): c.1005 + 2T>C | ATCATGGYAAGCAAGAAACAAGG | 458 | not provided |
| 199473074 | NM000335.4(SCN5A): c.6-88A>G (p.Ile230Val) | ATAYAGTTTTCAGGGCCCGGAGG, CTGATAYAGTTTTCAGGGCCCGG | 459 460 | Brugada syndrome |
| 111033273 | NM_206933.2(USH2A): c.1606T>C (p.Cys536Arg) | ATATAGAYGCCTCTGCTCCCAGG | 461 | Usher syndrome, type 2A |
| 72556290 | NM_000531.5(OTC): c.542A>G (p.Glu181Gly) | ATAGTGTYCCTAAAAGGCACGGG | 462 | not provided |
| 121918711 | NM_004612.3(TGFBR1): c.1199A>G (p.Asp400Gly) | ATAGATGYCAGCACGTTTGAAGG | 463 | Loeys-Dietz syndrome 1 |
| 104886288 | NM_000495.4(COL4A5): c.4699T>C (p.Cys1567Arg) | AGTAYGTGAAGCTCCAGCTGTGG | 464 | Alport syndrome, X-linked recessive |
| 144637717 | NM_016725.2(FOLR1): c.493 + 2T>C | CTTCAGGYGAGGGCTGGGGTGGG, AGGYGAGGGCTGGGGTGGGCAGG | 465 466 | not provided |
| 72558492 | NM_000531.5(OTC): c.1034A>G (p.Tyr345Cys) | AGGTGAGYAATCTGTCAGCAGGG | 467 | not provided |
| 62638745 | NM_000121.3(EPOR): c.1460A>G (p.Asn487Ser) | AGGGYTGGAGTAGGGGCCATCGG | 468 | Acute myeloid leukemia, M6 type, Familial erythrocytosis, 1 |
| 387907021 | NM_031427.3(DNAL1): c.449A>G (p.Asn150Ser) | AGGGAYTGCCTACAAACACCAGG | 469 | Kartagener syndrome, Ciliary dyskinesia, primary, 16 |
| 397514488 | NM_001161581.1 (POC1A):c.398T>C (p.Leu133Pro) | AGCYGTGGGACAAGAGCAGCCGG | 470 | Short stature, onychodysplasia, facial dysmorphism, and hypotrichosis |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 154774633 | NM_017882.2(CLN6): c.200T>C (p.Leu67Pro) | AGCYGGTATTCCCTCTCGAGTGG | 471 | Adult neuronal ceroid lipofuscinosis |
| 111033700 | NM_000155.3(GALT): c.482T>C (p.Leu161Pro) | AGCYGGGTGCCCAGTACCCTTGG | 472 | Deficiency of UDPglucose-hexose-1-phosphate uridylyltransferase |
| 128621198 | NM_000061.2(BTK): c.1223T>C (p.Leu408Pro) | GAGCYGGGGACTGGACAATTTGG, AGCYGGGGACTGGACAATTTGGG | 473 474 | X-linked agammaglobulinemia |
| 137852611 | NM_000211.4(ITGB2): c.446T>C (p.Leu149Pro) | AGCYAGGTGGCGACCTGCTCCGG | 475 | Leukocyte adhesion deficiency |
| 121908838 | NM_003722.4(TP63): c.697A>G (p.Lys233Glu) | AGCTTYTTTGTAGACAGGCATGG | 476 | Split-hand/foot malformation 4 |
| 397515869 | NM_000169.2(GLA): c.1153A>G (p.Thr385Ala) | AGCTGTGYGATGAAGCAGGCAGG | 477 | not specified |
| 118204064 | NM_000237.2(LPL): c.548A>G (p.Asp183Gly) | GCTGGAYCGAGGCCTTAAAAGGG, AGCTGGAYCGAGGCCTTAAAAGG | 478 479 | Hyperlipoproteinemia, type 1 |
| 128620186 | NM_000061.2(BTK): c.2T>C(p.Met1Thr) | AGCTAYGGCCGCAGTGATTCTGG | 480 | X-linked agammaglobulinemia |
| 786204132 | NM_014946.3(SPAST): c.1165A>G (p.Thr389Ala) | ATTGYCTTCCCATTCCCAGGTGG, AGCATTGYCTTCCCATTCCCAGG | 481 482 | Spastic paraplegia 4, autosomal dominant |
| 199473661 | NM_000218.2(KCNQ1): c.550T>C (p.Tyr184His) | CAGCAAGBACGTGGGCCTCTGGG, AGCAAGBACGTGGGCCTCTGGGG, GCAAGBACGTGGGCCTCTGGGGG | 483 484 485 | Congenital long QT syndrome, Cardiac arrhythmia |
| 387907129 | NM_024599.5 (RHBDF2):c.557T>C (p.Ile186Thr) | AGAYTGTGGATCCGCTGGCCCGG | 486 | Howel-Evans syndrome |
| 387906702 | NM_006306.3(SMC1A): c.2351T>C (p.Ile784Thr) | AGAYTGGTGTGCGCAACATCCGG | 487 | Congenital muscular hypertrophy-cerebral syndrome |
| 193929348 | NM_000525.3 (KCNJ11):c.544A>G (p.Ile182Val) | AGAYGAGGGTCTCAGCCCTGCGG | 488 | Permanent neonatal diabetes mellitus |
| 121908934 | NM_004086.2(COCH): c.1535T>C (p.Met512Thr) | AGATAYGGCTTCTAAACCGAAGG | 489 | Deafness, autosomal dominant 9 |
| 397514377 | NM_000060.3(BTD): c.641A>G (p.Asn214Ser) | AGAGGYTGTGTTTACGGTAGCGG | 490 | Biotinidase deficiency |
| 72552295 | NM_000531.5(OTC): c.2T>C(p.Met1Thr) | AGAAGAYGCTGTTTAATCTGAGG | 491 | not provided |
| 201893545 | NM_016247.3(IMPG2): c.370T>C (p.Phe124Leu) | ACTYTTTGGGATCGACTTCCTGG | 492 | Macular dystrophy, vitelliform, 5 |
| 121434469 | m.4290T>C | ACTYTGATAGAGTAAATAATAGG | 493 | |
| 121918733 | NM_006920.4(SCN1A): c.269T>C (p.Phe90Ser) | ACTTYTATAGTATTGAATAAAGG, CTTYTATAGTATTGAATAAAGGG | 494 495 | Severe myoclonic epilepsy in infancy |

TABLE E-continued

| List of disease-associated gene variants that could be base-edited therapeutically with an NGG PAM positioned appropriately (taken from Komor et al, Nature 2016, Suppl. FIG. 8) | | | |
|---|---|---|---|
| 121434471 m.4291T>C | ACTTYGATAGAGTAAATAATAGG | 496 | Hypertension, hypercholesterolemia, and hypomagnesemia, mitochondrial |
| 606231289 NM_001302946.1 (TRNT1):c.497T>C (p.Leu166Ser) | ACTTYATTTGACTACTTTAATGG | 497 | Sideroblastic anemia with B-cell immunodeficiency, periodic fevers, and developmental delay |
| 63750067 NM_000517.4(HBA2): c.*92A>G | CTTYATTCAAAGACCAGGAAGGG, ACTTYATTCAAAGACCAGGAAGG | 498 499 | Hemoglobin H disease, nondeletional |
| 121918734 NM_006920.4(SCN1A): c.272T>C (p.Ile91Thr) | ACTTTTAYAGTATTGAATAAAGG, CTTTTAYAGTATTGAATAAAGGG | 500 501 | Severe myoclonic epilepsy in infancy |
| 137854557 NM_000267.3(NF1): c.1466A>G (p.Tyr489Cys) | ACTTAYAGCTTCTTGTCTCCAGG | 502 | Neurofibromatosis, type 1 |
| 397514626 NM_018344.5 (SLC29A3):c.607T>C (p.Ser203Pro) | ACTGATAYCAGGTGAGAGCCAGG, CTGATAYCAGGTGAGAGCCAGGG | 503 504 | Histiocytosis-lymphadenopathy plus syndrome |
| 118204440 NM_000512.4(GALNS): c.1460A>G (p.Asn487Ser) | ACGYTGAGCTGGGGCTGCGCGGG, CACGYTGAGCTGGGGCTGCGCGG | 505 506 | Mucopoly-saccharidosis, MPS-1V-A |
| 587776843 NG_012088.1:g.2209 A>G | ACCYTATGATCCGCCCGCCTTGG | 507 | |
| 137853033 NM_001080463.1 (DYNC2H1):c.4610A>G (p.Gln1537Arg) | ACCYGTGAAGGGAACAGAGATGG | 508 | Short-rib thoracic dysplasia 3 with or without polydactyly |
| 28933698 NM_000435.2(NOTCH3): c.1363T>C (p.Cys455Arg) | TTCACCYGTATCTGTATGGCAGG, ACCYGTATCTGTATGGCAGGTGG | 509 510 | Cerebral autosomal dominant arteriopathy with subcortical infarcts and leukoencephalopathy |
| 587776766 NM_000463.2(UGT1A1): c.1085-2A>G | ACCYGAGATGCAAAATAGGGAGG, GTGACCYGAGATGCAAAATAGGG, GGTGACCYGAGATGCAAAATAGG | 511 512 513 | Crigler Najjar syndrome, type 1 |
| 587781628 NM_001128425.1 (MUTYH):c.1187-2A>G | ACCYGAGAGGGAGGGCAGCCAGG | 514 | Hereditary cancer-predisposing syndrome, Carcinoma of colon |
| 61755817 NM_000322.4(PRPH2): c.736T>C (p.Trp246Arg) | ACCTGYGGGTGCGTGGCTGCAGG, CCTGYGGGTGCGTGGCTGCAGGG | 515 516 | Retinitis pigmentosa |
| 121909184 NM_001089.2(ABCA3): c.1702A>G (p.Asn568Asp) | ACCGTYGTGGCCCAGCAGGACGG | 517 | Surfactant metabolism dysfunction,, pulmonary 3 |
| 121434466 m.4269A>G | ACAYATTTCTTAGGTTTGAGGGG, GACAYATTTCTTAGGTTTGAGGG, AGACAYATTTCTTAGGTTTGAGG | 518 519 520 | |
| 794726768 NM_001165963.1 (SCN1A):c.1048A>G (p.Met350Val) | ACAYATATCCCTCTGGACATTGG | 521 | Severe myoclonic epilepsy in infancy |
| 28934876 NM_001382.3(DPAGT1): c.509A>G (p.Tyr170Cys) | ACAYAGTACAGGATTCCTGCGGG, GACAYAGTACAGGATTCCTGCGG | 522 523 | Congenital disorder of glycosylation type 1J |
| 104894749 NM_000054.4(AVPR2): c.614A>G (p.Tyr205Cys) | ACAYAGGTGCGACGGCCCCAGGG, GACAYAGGTGCGACGGCCCCAGG | 524 525 | Nephrogenic diabetes insipidus, Nephrogenic diabetes insipidus, X-linked |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 128621205 NM_000061.2(BTK):<br>c.1741T>C<br>(p.Trp581Arg) | ACATTYGGGCTTTTGGTAAGTGG | 526 | X-linked<br>agammaglobulinemia |
| 28940892 NM_000529.2(MC2R):<br>c.761A>G<br>(p.Tyr254Cys) | ACATGYAGCAGGCGCAGTAGGGG,<br>GACATGYAGCAGGCGCAGTAGGG,<br>AGACATGYAGCAGGCGCAGTAGG | 527<br>528<br>529 | ACTH resistance |
| 794726844 NM_001165963.1<br>(SCN1A):c.1046A>G<br>(p.Tyr349Cys) | ACATAYATCCCTCTGGACATTGG | 530 | Severe myoclonic<br>epilepsy in infancy |
| 587783083 NM_003159.2(CDKL5):<br>c.449A>G<br>(p.Lys150Arg) | ACAGTYTTAGGACATCATTGTGG | 531 | not provided |
| 397514651 NM_000108.4(DLD):<br>c.140T>C(p.Ile47Thr) | ACAGTTAYAGGTTCTGGTCCTGG,<br>GTTAYAGGTTCTGGTCCTGGAGG | 532<br>533 | Maple syrup urine<br>disease, type 3 |
| 794727060 NM_001848.2(COL6A1):<br>c.957 + 2T>C | ACAAGGYGAGCGTGGGCTGCTGG,<br>CAAGGYGAGCGTGGGCTGCTGGG | 534<br>535 | Ullrich congenital<br>muscular dystrophy,<br>Bethlem myopathy |
| 72554346 NM_000531.5(OTC):<br>c.284T>C(p.Leu95Ser) | ACAAGATYGTCTACAGAAACAGG | 536 | not provided |
| 483353031 NM_002136.2<br>(HNRNPA1):c.841T>C<br>(p.Phe281Leu) | AATYTTGGAGGCAGAAGCTCTGG | 537 | Chronic progressive<br>multiple sclerosis |
| 104894271 NM_000315.2(PTH):<br>c.52T>C(p.Cys18Arg) | AATTYGTTTTCTTACAAAATCGG | 538 | Hypoparathyroidism<br>familial isolated |
| 267608260 NM_015599.2(PGM3):<br>c.248T>C<br>(p.Leu83Ser) | AATGTYGGCACCATCCTGGGAGG | 539 | Immunodeficiency 23 |
| 267606900 NM_018109.3(MTPAP):<br>c.1432A>G<br>(p.Asn478Asp) | AATGGATYCTGAATGTACAGAGG | 540 | Ataxia, spastic, 4,<br>autosomal recessive |
| 796053169 NM_021007.2(SCN2A):<br>c.387-2A>G | AATAAAGYAGAATATCGTCAAGG | 541 | not provided |
| 104894937 NM_000116.4(TAZ):<br>c.352T>C<br>(p.Cys118Arg) | AAGYGTGTGCCTGTGTGCCGAGG | 542 | 3-Methylglutaconic<br>aciduria type 2 |
| 104893911 NM_001018077.1<br>(NR3C1):c.1712T>C<br>(p.Val571Ala) | AAGYGATTGCAGCAGTGAAATGG | 543 | Pseudoherma-<br>phroditism,<br>female, with<br>hypokalemia, due<br>to glucocorticoid<br>resistance |
| 397514472 NM_004813.2(PEX16):<br>c.992A>G<br>(p.Tyr331Cys) | AAGYAGATTTTCTGCCAGGTGGG,<br>GAAGYAGATTTTCTGCCAGGTGG,<br>GTAGAAGYAGATTTTCTGCCAGG | 544<br>545<br>546 | Peroxisome<br>biogenesis<br>disorder 8B |
| 121918407 NM_001083112.2(GPD2):<br>c.1904T>C<br>(p.Phe635Ser) | AAGTYTGATGCAGACCAGAAAGG | 547 | Diabetes mellitus<br>type 2 |
| 63751110 NM_000251.2(MSH2):<br>c.595T>C<br>(p.Cys199Arg) | AAGGAAYGTGTTTTACCCGGAGG | 548 | Hereditary<br>Nonpolyposis<br>Colorectal<br>Neoplasms |
| 119450945 NM_000026.2(ADSL):<br>c.674T>C<br>(p.Met225Thr) | AAGAYGGTGACAGAAAAGGCAGG | 549 | Adenylosuccinate<br>lyase deficiency |
| 113993988 NM_002863.4(PYGL):<br>c.2461T>C<br>(p.Tyr821His) | AAGAAYATGCCCAAAACATCTGG | 550 | Glycogen storage<br>disease, type VI |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 119485091 | NM_022041.3(GAN):<br>c.1268T>C<br>(p.Ile423Thr) | AAGAAAAYCTACGCCATGGGTGG,<br>AAAAYCTACGCCATGGGTGGAGG | 551<br>552 | Giant axonal<br>neuropathy |
| 137852419 | NM_000132.3(F8):<br>c.1660A>G<br>(p.Ser554Gly) | AACYAGAGTAATAGCGGGTCAGG | 553 | Hereditary factor<br>VIII deficiency<br>disease |
| 121964967 | NM_000071.2(CBS):<br>c.1150A>G<br>(p.Lys384Glu) | AACTYGGTCCTGCGGGATGGGGG,<br>GAACTYGGTCCTGCGGGATGGGG,<br>GGAACTYGGTCCTGCGGGATGGG,<br>AGGAACTYGGTCCTGCGGGATGG | 554<br>555<br>556<br>557 | Homocystinuria,<br>pyridoxine-<br>responsive |
| 137852376 | NM_000132.3(F8):<br>c.1754T>C<br>(p.Ile585Thr) | AACAGAYAATGTCAGACAAGAGG | 558 | Hereditary factor<br>VIII deficiency<br>disease |
| 121917930 | NM_006920.4(SCN1A):<br>c.3577T>C<br>(p.Trp1193Arg) | AACAAYGGTGGAACCTGAGAAGG | 559 | Generalized epilepsy<br>with febrile seizures<br>plus, type 1,<br>Generalized epilepsy<br>with febrile seizures<br>plus, type 2 |
| 28939717 | NM_003907.2<br>(EIF2B5):c.271A>G<br>(p.Thr91Ala) | AAATGYTTCCTGTACACCTGTGG | 560 | Leukoencephalopathy<br>with vanishing white<br>matter |
| 80357276 | NM_007294.3(BRCA1):<br>c.122A>G<br>(p.His41Arg) | AAATATGYGGTCACACTTTGTGG | 561 | Familial cancer of<br>breast, Breast-<br>ovarian cancer,<br>familial 1 |
| 397515897 | NM_000256.3(MYBPC3):<br>c.1351 + 2T>C | AAAGGYGGGCCTGGGACCTGAGG | 562 | Familial hypertrophic<br>cardiomyopathy 4,<br>Cardiomyopathy |
| 397514491 | NM_005340.6(HINT1):<br>c.152A>G<br>(p.His51Arg) | AAAAYGTGTTGGTGCTTGAGGGG,<br>GAAAAYGTGTTGGTGCTTGAGGG,<br>AGAAAAYGTGTTGGTGCTTGAGG | 563<br>564<br>565 | Gamstorp-Wohlfart<br>syndrome |
| 387907164 | NM_020894.2(UVSSA):<br>c.94T>C<br>(p.Cys32Arg) | AAAATTYGCAAGTATGTCTTAGG,<br>AAATTYGCAAGTATGTCTTAGGG | 566<br>567 | UV-sensitive syndrome<br>3 |
| 118161496 | NM_025152.2(NUBPL):<br>c.815-27T>C | TGGTTCYAATGGATGTCTGCTGG,<br>GGTTCYAATGGATGTCTGCTGGG | 568<br>569 | Mitochondrial complex<br>I deficiency |
| 764313717 | NM_005609.2(PYGM):<br>c.425_528del | TGGCTGYCAGGGACCCAGCAAGG,<br>CTGYCAGGGACCCAGCAAGGAGG | 570<br>571 | |
| 28934568 | NM_003242.5<br>(TGFBR2):c.923T>C<br>(p.Leu308Pro) | AGTTCCYGACGGCTGAGGAGCGG | 572 | Loeys-Dietz<br>syndrome 2 |
| 121913461 | NM_007313.2(ABL1):<br>c.814T>C<br>(p.Tyr272His) | CCAGYACGGGGAGGTGTACGAGG,<br>CAGYACGGGGAGGTGTACGAGGG | 573<br>574 | |
| 377750405 | NM_173551.4(ANKS6):<br>c.1322A>G<br>(p.Gln441Arg) | AGGGCYGTCGGACCTTCGAGTGG,<br>GGGCYGTCGGACCTTCGAGTGGG,<br>GGCYGTCGGACCTTCGAGTGGGG | 575<br>576<br>577 | Nephronophthisis 16 |
| 57639980 | NM_001927.3(DES):<br>c.1034T>C<br>(p.Leu345Pro) | ATTCCCYGATGAGGCAGATGCGG,<br>TTCCCYGATGAGGCAGATGCGGG | 578<br>579 | Myofibrillar<br>myopathy 1 |
| 147391618 | NM_020320.3(RARS2):<br>c.35A>G<br>(p.Gln12Arg) | ATACCYGGCAAGCAATAGCGCGG | 580 | Pontocerebellar<br>hypoplasia type 6 |
| 182650126 | NM_002977.3(SCN9A):<br>c.2215A>G<br>(p.Ile739Val) | GTAAYTGCAAGATCTACAAAAGG | 581 | Small fiber<br>neuropathy |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 80358278 | NM_004700.3(KCNQ4):<br>c.842T>C<br>(p.Leu281Ser) | ACATYGACAACCATCGGCTATGG | 582 | DFNA 2 Nonsyndromic<br>Hearing Loss |
| 786204012 | NM_005957.4(MTHFR):<br>c.388T>C<br>(p.Cys130Arg) | GACCYGCTGCCGTCAGCGCCTGG | 583 | Homocysteinemia due<br>to MTHFR deficiency |
| 786204037 | NM_005957.4(MTHFR):<br>c.1883T>C<br>(p.Leu628Pro) | TCCCACYGGACAACTGCCTCTGG | 584 | Homocysteinemia due<br>to MTHFR deficiency |
| 202147607 | NM_000140.3(FECH):<br>c.1137 + 3A>G | GTAGAYACCTTAGAGAACAATGG | 585 | Erythropoietic<br>protoporphyria |
| 122456136 | NM_005183.3(CACNA1F):<br>c.2267T>C<br>(p.Ile756Thr) | TGCCAYTGCTGTGGACAACCTGG | 586 | |
| 786204851 | NM_007374.2(SIX6):<br>c.110T>C(p.Leu37Pro) | GTCGCYGCCCGTGGCCCCTGCGG | 587 | Cataract,<br>microphthalmia and<br>nystagmus |
| 794728167 | NM_000138.4(FBN1):<br>c.1468 + 2T>C | ATTGGYACGTGATCCATCCTAGG | 588 | Thoracic aortic<br>aneurysms and aortic<br>dissections |
| 121964909 | NM_000027.3(AGA):<br>c.214T>C(p.Ser72Pro) | GACGGCYCTGTAGGCTTTGGAGG | 589 | Aspartylglycosaminuria |
| 121964978 | NM_000170.2(GLDC):<br>c.2T>C(p.Met1Thr) | CGGCCAYGCAGTCCTGTGCCAGG,<br>GGCCAYGCAGTCCTGTGCCAGGG | 590<br>591 | Non-ketotic<br>hyperglycinemia |
| 121965008 | NM_000398.6(CYB5R3):<br>c.446T>C<br>(p.Leu149Pro) | CTGCYGGTCTACCAGGGCAAAGG | 592 | METHEMOGLOBINEMIA,<br>TYPE I |
| 121965064 | NM_000128.3(F11):<br>c.901T>C<br>(p.Phe301Leu) | TGATYTCTTGGGAGAAGAACTGG | 593 | Hereditary factor XI<br>deficiency disease |
| 45517398 | NM_000548.3(TSC2):<br>c.5150T>C<br>(p.Leu1717Pro) | GCCCYGCACGCAAATGTGAGTGG,<br>CCCYGCACGCAAATGTGAGTGGG | 594<br>595 | Tuberous sclerosis<br>syndrome |
| 786205857 | NM_015662.20FT172):<br>c.770T>C<br>(p.Leu257Pro) | TTGTGCYAGGAAGTTATGACAGG | 596 | RETINITIS<br>PIGMENTOSA 71 |
| 786205904 | NM_001135669.1<br>(XPR1):c.653T>C<br>(p.Leu218Ser) | GCGTTYACGTGTCCCCCCTTTGG,<br>CGTTYACGTGTCCCCCCTTTGGG | 597<br>598 | BASAL GANGLIA<br>CALCIFICATION,<br>IDIOPATHIC, 6 |
| 104893704 | NM_000388.3(CASR):<br>c.2641T>C<br>(p.Phe881Leu) | ACGCTYCAAGGTGGCTGCCCGG,<br>CGCTYCAAGGTGGCTGCCCGGG | 599<br>600 | Hypercalciuric<br>hypercalcemia |
| 104893747 | NM_198159.2(MITF):<br>c.1195T>C<br>(p.Ser399Pro) | ACTTYCCCTTATTCCATCCACGG,<br>CTTYCCCTTATTCCATCCACGGG | 601<br>602 | Waardenburg syndrome<br>type 2A |
| 104893770 | NM_000539.3(RHO):<br>c.133T>C<br>(p.Phe45Leu) | CATGYTTCTGCTGATCGTGCTGG,<br>ATGYTTCTGCTGATCGTGCTGGG | 603<br>604 | Retinitis<br>pigmentosa 4 |
| 28937596 | NM_003907.2(EIF2B5):<br>c.1882T>C<br>(p.Trp628Arg) | AGGCCYGGAGCCCTGTTTTTAGG | 605 | Leukoencephalopathy<br>with vanishing white<br>matter |
| 104893876 | NM_001151.3(SLC25A4):<br>c.293T>C<br>(p.Leu98Pro) | GCAGCYCTTCTTAGGGGGTGTGG | 606 | Autosomal dominant<br>progressive external<br>ophthalmoplegia with<br>mitochondrial DNA<br>deletions 2 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 104893883 NM_006005.3(WFS1): c.2486T>C (p.Leu829Pro) | ACCATCCYGGAGGGCCGCCTGGG | 607 | WFS1-Related Disorders |
| 104893962 NM_000165.4(GJA1): c.52T>C(p.Ser18Pro) | CTACYCAACTGCTGGAGGGAAGG | 608 | Oculodentodigital dysplasia |
| 104893978 NM_000434.3(NEU1): c.718T>C (p.Trp240Arg) | GCCTCCYGGCGCTACGGAAGTGG, CCTCCYGGCGCTACGGAAGTGGG, CTCCYGGCGCTACGGAAGTGGGG | 609 610 611 | Sialidosis, type II |
| 104894092 NM_002546.3 (TNFRSF11B):c.349T>C (p.Phe117Leu) | TAGAGYTCTGCTTGAAACATAGG | 612 | Hyperphosphatasemia with bone disease |
| 104894135 NM_000102.3(CYP17A1): c.316T>C (p.Ser106Pro) | CATCGCGYCCAACAACCGTAAGG, ATCGCGYCCAACAACCGTAAGGG | 613 614 | Complete combined 17-alphahydroxylase/ 17,20-lyase deficiency |
| 104894151 NM_000102.3(CYP17A1): c.1358T>C (p.Phe453Ser) | AGCTCTYCCTCATCATGGCCTGG | 615 | Combined partial 17-alpha-hydroxylase/ 17,20 lyase deficiency |
| 36015961 NM_000518.4(HBB): c.344T>C (p.Leu115Pro) | TGTGTGCYGGCCCATCACTTTGG | 616 | Beta thalassemia intermedia |
| 104894472 NM_152443.2(RDH12): c.523T>C (p.Ser175Pro) | TCCYCGGTGGCTCACCACATTGG | 617 | Leber congenital amaurosis 13 |
| 104894587 NM_004870.3(MPDU1): c.356T>C (p.Leu119Pro) | TTCCYGGTCATGCACTACAGAGG | 618 | Congenital disorder of glycosylation type 1F |
| 104894588 NM_004870.3(MPDU1): c.2T>C(p.Met1Thr) | AATAYGGCGGCCGAGGCGGACGG | 619 | Congenital disorder of glycosylation type 1F |
| 104894626 NM_000304.3(PMP22): c.82T>C (p.Trp28Arg) | TAGCAAYGGATCGTGGGCAATGG | 620 | Charcot-Marie-Tooth disease, type IE |
| 104894631 NM_018129.3(PNPO): c.784T>C (p.Ter262Gln) | ACCTYAACTCTGGGACCTGCTGG | 621 | "Pyridoxal 5-phosphate-dependent epilepsy" |
| 104894703 NM_032551.4(KISS1R): c.305T>C (p.Leu102Pro) | GCCCTGCYGTACCCGCTGCCCGG, TGCYGTACCCGCTGCCCGGCTGG | 622 623 | |
| 104894826 NM_000166.5(GJB1): c.407T>C (p.Val136Ala) | ATGYCATCAGCGTGGTGTTCCGG | 624 | Dejerine-Sottas disease, X-linked hereditary motor and sensory neuropathy |
| 104894859 NM_001122606.1 (LAMP2):c.961T>C (p.Trp321Arg) | CAGCTACYGGGATGCCCCCCTGG, AGCTACYGGGATGCCCCCCTGGG | 625 626 | Danon disease |
| 104894931 NM_006517.4(SLC16A2): c.1313T>C (p.Leu438Pro) | TGAGCYGGTGGGCCCAATGCAGG | 627 | Allan-Herndon-Dudley syndrome |
| 104894935 NM_000330.3(RS1): c.38T>C(p.Leu13Pro) | TTACTTCYCTTTGGCTATGAAGG | 628 | Juvenile retinoschisis |
| 104895217 NM_001065.3 (TNFRSF1A):c.175T>C (p.Cys59Arg) | TGCYGTACCAAGTGCCACAAAGG | 629 | TNF receptor-associated periodic fever syndrome (TRAPS) |
| 143889283 NM_003793.3(CTSF): c.692A>G (p.Tyr231Cys) | CTCCAYACTGAGCTGTGCCACGG | 630 | Ceroid lipofuscinosis, neuronal, 13 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 122459147 | NM_001159702.2(FHL1): c.310T>C (p.Cys104Arg) | GGGGYGCTTCAAGGCCATTGTGG | 631 | Myopathy, reducing body, X-linked, childhood onset |
| 74552543 | NM_020184.3(CNNM4): c.971T>C (p.Leu324Pro) | AAGCTCCYGGACTTTTTTCTGGG | 632 | Cone-rod dystrophy amelogenesis imperfecta |
| 199476117 | m.10158T>C | AAAYCCACCCCTTACGAGTGCGG | 633 | Leigh disease, Leigh syndrome due to mitochondrial complex I deficiency, Mitochondrial complex I deficiency |
| 794727808 | NM_020451.2(SEPN1): c.872 + 2T>C | TTCCGGYGAGTGGGCCACACTGG | 634 | Congenital myopathy with fiber type disproportion, Eichsfeld type congenital muscular dystrophy |
| 140547520 | NM_005022.3(PFN1): c.350A>G (p.Glu117Gly) | CACCTYCTTTGCCCATCAGCAGG | 635 | Amyotrophic lateral sclerosis 18 |
| 397514359 | NM_000060.3(BTD): c.445T>C (p.Phe149Leu) | TCACCGCYTCAATGACACAGAGG | 636 | Biotinidase deficiency |
| 207460001 | m.15197T>C | CTAYCCGCCATCCCATACATTGG | 637 | Exercise intolerance |
| 397514406 | NM_000060.3(BTD): c.1214T>C (p.Leu405Pro) | TTCACCCYGGTCCCTGTCTGGGG | 638 | Biotinidase deficiency |
| 397514516 | NM_006177.3(NRL): c.287T>C (p.Met96Thr) | GAGGCCAYGGAGCTGCTGCAGGG | 639 | Retinitis pigmentosa 27 |
| 72554312 | NM_000531.5(OTC): c.134T>C (p.Leu45Pro) | CTCACTCYAAAAAACTTTACCGG | 640 | Ornithine carbamoyltransferase deficiency |
| 397514569 | NM_178012.4(TUBB2B): c.350T>C (p.Leu117Pro) | GGTCCYGGATGTGGTGAGGAAGG | 641 | Polymicrogyria, asymmetric |
| 397514571 | NM000431.3(MVK): c.122-T>C (p.Leu41Pro) | CGGCYTCAACCCCACAGCAATGG, GGCYTCAACCCCACAGCAATGGG | 642 643 | Porokeratosis, disseminated superficial actinic 1 |
| 794728390 | NM_000238.3(KCNH2): c.2396T>C (p.Leu799Pro) | GCCATCCYGGGTATGGGGTGGGG, CCATCCYGGGTATGGGGTGGGGG, CATCCYGGGTATGGGGTGGGGGG | 644 645 646 | Cardiac arrhythmia |
| 397514713 | NM_001199107.1 (TBC1D24):c.686T>C (p.Phe229Ser) | GGTCTYTGACGTCTTCCTGGTGG | 647 | Early infantile epileptic encephalopathy 16 |
| 397514719 | NM_080605.3(B3GALT6): c.193A>G (p.Ser65Gly) | CGCYGGCCACCAGCACTGCCAGG | 648 | Spondyloepimetaphyseal dysplasia with joint laxity |
| 730880608 | NM_000256.3(MYBPC3): c.3796T>C (p.Cys1266Arg) | GAGYGCCGCCTGGAGGTGCGAGG | 649 | Cardiomyopathy |
| 397515329 | NM_001382.3(DPAGT1): c.503T>C (p.Leu168Pro) | AATCCYGTACTATGTCTACATGG, ATCCYGTACTATGTCTACATGGG, TCCYGTACTATGTCTACATGGGG | 650 651 652 | Congenital disorder of glycosylation type 1J |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 397515465 | NM_018127.6(ELAC2): c.460T>C (p.Phe154Leu) | ATAYTTTCTGGTCCATTGAAAGG | 653 | Combined oxidative phosphorylation deficiency 17 |
| 397515557 | NM_005211.3(CSF1R): c.2483T>C (p.Phe828Ser) | CATCTYTGACTGTGTCTACACGG | 654 | Hereditary diffuse leukoencephalopathy with spheroids |
| 397515599 | NM_194248.2(OTOF): c.3413T>C (p.Leu1138Pro) | AGGTGCYGTTCTGGGGCCTACGG, GGGTGCYGTTCTGGGGCCTACGGG | 655 656 | Deafness, autosomal recessive 9 |
| 397515766 | NM_000138.4(FBN1): c.2341T>C (p.Cys781Arg) | GGACAAYGTAGAAATACTCCTGG | 657 | Marfan syndrome |
| 565779970 | NM_001429.3(EP300): c.3573T>A (p.Tyr1191Ter) | CTTAYTACAGTTACCAGAACAGG | 658 | Rubinstein-Taybi syndrome 2 |
| 786200938 | NM_080605.3(B3GALT6): c.1A>G (p.Met1Val) | AGCTTCAYGGCGCCCGCGCCGGG, TCAYGGCGCCCGCGCCGGGCCGG | 659 660 | Spondyloepimetaphyseal dysplasia with joint laxity |
| 28942087 | NM_000229.1(LCAT): c.698T>C (p.Leu233Pro) | ATCTCTCYTGGGGCTCCCTGGGG, TCTCYTGGGGCTCCCTGGGGTGG | 661 662 | Norum disease |
| 128621203 | NM_000061.2(BTK): c.1625T>C (p.Leu542Pro) | TCGGCCYGTCCAGGTGAGTGTGG | 663 | X-linked agammaglobulinemia with growth hormone deficiency |
| 397515412 | NM_006383.3(CIB2): c.368T>C (p.Ile123Thr) | CTTCAYCTGCAAGGAGGACCTGG | 664 | Deafness, autosomal recessive 48 |
| 193929364 | NM_000352.4(ABCC8): c.404T>C (p.Leu135Pro) | AAGCYGCTAATTGGTAGGTGAGG | 665 | Permanent neonatal diabetes mellitus |
| 730880872 | NM_000257.3(MYH7): c.1400T>C (p.Ile467Thr) | TCGAGAYCTTCGATGTGAGTTGG, CGAGAYCTTCGATGTGAGTTGGG | 666 667 | Cardiomyopathy |
| 80356474 | NM_002977.3(SCN9A): c.2543T>C (p.Ile848Thr) | AAGATCAYTGGTAACTCAGTAGG, AGATCAYTGGTAACTCAGTAGGG, GATCAYTGGTAACTCAGTAGGGG | 668 669 670 | Primary erythromelalgia |
| 80356489 | NM_001164277.1 (SLC37A4):c.352T>C (p.Trp118Arg) | GGGCYGGCCCCCATGTGGGAAGG | 671 | Glucose-6-phosphate transport defect |
| 80356536 | NM_152296.4(ATP1A3): c.2338T>C (p.Phe780Leu) | GCCCYTCCTGCTGTTCATCATGG | 672 | Dystonia 12 |
| 80356596 | NM_194248.2(OTOF): c.3032T>C (p.Leu1011Pro) | GATGCYGGTGTTCGACAACCTGG | 673 | Deafness, autosomal recessive 9, Auditory neuropathy, autosomal recessive, 1 |
| 80356689 | NM_000083.2(CLCN1): c.857T>C (p.Val286Ala) | AGGAGYGCTATTTAGCATCGAGG | 674 | Myotonia congenita |
| 118203884 | m.4409T>C | AGGYCAGCTAAATAAGCTATCGG | 675 | Mitochondrial myopathy |
| 587777625 | NM_173596.2 (SLC39A5):c.911T>C (p.Met304Thr) | AGAACAYGCTGGGGCTTTTGCGG | 676 | Myopia 24, autosomal dominant |
| 587783087 | NM_003159.2(CDKL5): c.602T>C (p.Leu201Pro) | ATTCYTGGGGAGCTTAGCGATGG | 677 | not provided |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 118203951 | NM_013319.2(UBIAD1):<br>c.511T>C<br>(p.Ser171Pro) | TCTGGCYCCTTTCTCTACACAGG,<br>GGCYCCTTTCTCTACACAGGAGG | 678<br>679 | Schnyder crystalline<br>corneal dystrophy |
| 118204017 | NM_000018.3(ACADVL):<br>c.1372T>C<br>(p.Phe458Leu) | TCGCATCYTCCGGATCTTTGAGG,<br>CGCATCYTCCGGATCTTTGAGGG,<br>GCATCYTCCGGATCTTTGAGGGG | 680<br>681<br>682 | Very long chain acyl-<br>CoA dehydrogenase<br>deficiency |
| 397518466 | NM_000833.4(GRIN2A):<br>c.2T>C(p.Met1Thr) | CTAYGGGCAGAGTGGGCTATTGG | 683 | Focal epilepsy with<br>speech disorder with<br>or without mental<br>retardation |
| 118204069 | NM_000237.2(LPL):<br>c.337T>C<br>(p.Trp113Arg) | GGACYGGCTGTCACGGGCTCAGG | 684 | Hyperlipoproteinemia,<br>type 1 |
| 118204080 | NM_000237.2(LPL):<br>c.755T>C(p.Ile252Thr) | GTGAYTGCAGAGAGAGGACTTGG | 685 | Hyperlipoproteinemia,<br>type 1 |
| 118204111 | NM_000190.3(HMBS):<br>c.739T>C<br>(p.Cys247Arg) | GCTTCGCYGCATCGCTGAAAGGG | 686 | Acute intermittent<br>porphyria |
| 80357438 | NM_007294.3(BRCA1):<br>c.65T>C<br>(p.Leu22Ser) | AAATCTYAGAGTGTCCCATCTGG | 687 | Familial cancer of<br>breast, Breast-<br>ovarian cancer,<br>familial 1,<br>Hereditary cancer<br>predisposing syndrome |
| 139877390 | NM_001040431.2(COA3):<br>c.215A>G<br>(p.Tyr72Cys) | CCAYCTGGGGAGGTAGGTTCAGG | 688 | |
| 793888527 | NM_005859.4(PURA):<br>c.563T>C,<br>(p.Ile188Thr) | GACCAYTGCGCTGCCCGCGCAGG,<br>ACCAYTGCGCTGCCCGCGCAGGG,<br>CCAYTGCGCTGCCCGCGCAGGGG | 689<br>690<br>691 | not provided, Mental<br>retardation, autosomal<br>dominant 31 |
| 561425038 | NM_002878.3(RAD51D):<br>c.1A>G<br>(p.Met1Val) | CGCCCAYGTTCCCCGCAGGCCGG | 692 | Hereditary cancer-<br>predisposing syndrome |
| 121907934 | NM_024105.3(ALG12):<br>c.473T>C<br>(p.Leu158Pro) | TCCYGCTGGCCCTCGCGGCCTGG | 693 | Congenital disorder of<br>glycosylation type 1G |
| 80358207 | NM_153212.2(GJB4):<br>c.409T>C<br>(p.Phe137Leu) | CCTCATCYTCAAGGCCGCCGTGG | 694 | Erythrokeratodermia<br>variabilis |
| 80358228 | NM_002353.2(TACSTD2):<br>c.557T>C<br>(p.Leu186Pro) | TCGGCYGCACCCCAAGTTCGTGG | 695 | Lattice corneal<br>dystrophy Type III |
| 121908076 | NM_138691.2(TMC1):<br>c.1543T>C<br>(p.Cys515Arg) | AGGACCTYGCTGGGAAACAATGG,<br>ACCTYGCTGGGAAACAATGGTGG,<br>CCTYGCTGGGAAACAATGGTGGG | 696<br>697<br>698 | Deafness, autosomal<br>recessive 7 |
| 121908089 | NM_017838.3(NHP2):<br>c.415T>C<br>(p.Tyr139His) | GGAGGCTYACGATGAGTGCCTGG,<br>GGCTYACGATGAGTGCCTGGAGG | 699<br>700 | Dyskeratosis congenita<br>autosomal recessive 1,<br>Dyskeratosis<br>congenita,<br>autosomal recessive 2 |
| 121908154 | NM_001243133.1<br>(NLRP3):c.926T>C<br>(p.Phe309Ser) | GGTGCCTYTGACGAGCACATAGG | 701 | Familial cold<br>urticaria,<br>Chronic infantile<br>neurological,<br>cutaneous<br>and articular syndrome |
| 121908158 | NM_001033855.2<br>(DCLRE1C):c.2T>C<br>(p.Met1Thr) | GGCGCTAYGAGTTCTTTCGAGGG,<br>GCGCTAYGAGTTCTTTCGAGGGG | 702<br>703 | Histiocytic medullary<br>reticulosis |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 796052870 | NM_018129.3(PNPO): c.2T>C(p.Met1Thr) | CCCCCAYGACGTGCTGGCTGCGG, CCCCAYGACGTGCTGGCTGCGGG, CCCAYGACGTGCTGGCTGCGGGG | 704 705 706 | not provided |
| 121908318 | NM_020427.2(SLURP1): c.43T>C (p.Trp15Arg) | GCAGCCYGGAGCATGGGCTGTGG | 707 | Acroerythrokeratoderma |
| 121908352 | NM_022124.5(CDH23): c.5663T>C (p.Phe1888Ser) | CTCACCTYCAACATCACTGCGGG | 708 | Deafness, autosomal recessive 12 |
| 121908520 | NM_000030.2(AGXT): c.613T>C (p.Ser205Pro) | CCTGTACYCGGGCTCCCAGAAGG | 709 | Primary hyperoxaluria, type 1 |
| 121908618 | NM_004273.4(CHST3): c.920T>C (p.Leu307Pro) | CGTGCYGGCCTCGCGCATGGTGG | 710 | Spondyloepiphyseal dysplasia with congenital joint dislocations |
| 11694 | NM_006432.3(NPC2): c.199T>C (p.Ser67Pro) | TATTCAGYCTAAAAGCAGCAAGG | 711 | Niemann-Pick disease type C2 |
| 121908739 | NM_000022.2(ADA): c.320T>C (p.Leu107Pro) | CCTGCYGGCCAACTCCAAAGTGG | 712 | Severe combined immunodeficiency due to ADA deficiency |
| 80359022 | NM_000059.3(BRCA2): c.7958T>C (p.Leu2653Pro) | TGCYTCTTCAACTAAAATACAGG | 713 | Familial cancer of breast, Breast-ovarian cancer, familial 2 |
| 121908902 | NM_003880.3(WISP3): c.232T>C (p.Cys78Arg) | AAAATCYGTGCCAAGCAACCAGG, AAATCYGTGCCAAGCAACCAGGG, AATCYGTGCCAAGCAACCAGGGG | 714 715 716 | Progressive pseudorheumatoid dysplasia |
| 121908947 | NM_006892.3(DNMT3B): c.808T>C (p.Ser270Pro) | CAAGTTCYCCGAGGTGAGTCCGG, AAGTTCYCCGAGGTGAGTCCGGG, AGTTCYCCGAGGTGAGTCCGGGG | 717 718 719 | Centromeric instability of chromosomes 1,9 and 16 and immunodeficiency |
| 121909028 | NM_000492.3(CFTR): c.3857T>C (p.Phe1286Ser) | AGCCTYTGGAGTGATACCACAGG | 720 | Cystic fibrosis |
| 121909135 | NM_000085.4(CLCNKB): c.1294T>C (p.Tyr432His) | CTTTGTCYATGGTGAGTCTGGGG | 721 | Baiter syndrome type 3 |
| 121909143 | NM_001300.5(KLF6): c.506T>C (p.Leu169Pro) | GGAGCYGCCCTCGCCAGGGAAGG | 722 | |
| 121909182 | NM_001089.2(ABCA3): c.302T>C (p.Leu101Pro) | GCACYTGTGATCAACATGCGAGG | 723 | Surfactant metabolism dysfunction, pulmonary, 3 |
| 121909200 | NM_000503.5(EYA1): c.1459T>C (p.Ser487Pro) | CACTCYCGCTCATTCACTCCCGG | 724 | Melnick-Fraser syndrome |
| 121909247 | NM_004970.2(IGFALS): c.1618T>C (p.Cys540Arg) | GGACYGTGGCTGCCCTCTCAAGG | 725 | Acid-labile subunit deficiency |
| 121909253 | NM_005570.3(LMAN1): c.2T>C(p.Met1Thr) | AGAYGGCGGGATCCAGGCAAAGG | 726 | Combined deficiency of factor V and factor VIII, 1 |
| 121909385 | NM_000339.2(SLC12A3): c.1868T>C (p.Leu623Pro) | CAACCYGGCCCTCAGCTACTCGG | 727 | Familial hypokalemia-hypomagnesemia |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121909497 NM_002427.3(MMP13):<br>c.224T>C<br>(p.Phe75Ser) | TTCTYCGGCTTAGAGGTGACTGG | 728 | Spondyloepimetaphysea<br>I dysplasia, Missouri<br>type |
| 121909508 NM_000751.2(CHRND):<br>c.188T>C<br>(p.Leu63Pro) | AACCYCATCTCCCTGGTGAGAGG | 729 | MYASTHENIC<br>SYNDROME,<br>CONGENITAL, 3B,<br>FAST-CHANNEL |
| 121909519 NM_001100.3(ACTA1):<br>c.287T>C<br>(p.Leu96Pro) | CGAGCYTCGCGTGGCTCCCGAGG | 730 | Nemaline myopathy 3 |
| 121909572 NM_000488.3<br>(SERPINC1):c.667T>C<br>(p.Ser223Pro) | TGGGTGYCCAATAAGACCGAAGG | 731 | Antithrombin III<br>deficiency |
| 121909677 NM_000821.6(GGCX):<br>c.896T>C<br>(p.Phe299Ser) | TATGTYCTCCTACGTCATGCTGG | 732 | Pseudoxanthoma<br>elasticum-like<br>disorder with<br>multiple coagulation<br>factor deficiency |
| 121909727 NM_001018077.1<br>(NR3C1):c.2209T>C<br>(p.Phe737Leu) | CTATTGCYTCCAAACATTTTTGG | 733 | Glucocorticoid<br>resistance,<br>generalized |
| 139573311 NM_000492.3(CFTR):<br>c.1400T>C<br>(p.Leu467Pro) | TTCACYTCTAATGGTGATTATGG,<br>TCACYTCTAATGGTGATTATGGG | 734<br>735 | Cystic fibrosis |
| 121912441 NM_000454.4(SOD1):<br>c.341T>C<br>(p.Ile114Thr) | CATCAYTGGCCGCACACTGGTGG | 736 | Amyotrophic lateral<br>sclerosis type 1 |
| 121912446 NM_000454.4(SOD1):<br>c.434T>C<br>(p.Leu145Ser) | CGTTYGGCTTGTGGTGTAATTGG,<br>GTTYGGCTTGTGGTGTAATTGGG | 737<br>738 | Amyotrophic lateral<br>sclerosis type 1 |
| 121912463 NM_000213.3(1TGB4):<br>c.1684T>C<br>(p.Cys562Arg) | GGCCAGYGTGTGTGTGAGCCTGG | 739 | Epidermolysis bullosa<br>with pyloric atresia |
| 121912492 NM_002292.3(LAMB2):<br>c.961T>C<br>(p.Cys321Arg) | CCTCAACYGCGAGCAGTGTCAGG | 740 | Nephrotic syndrome,<br>type 5, with or<br>without ocular<br>abnormalities |
| 397516659 NM_001399.4(EDA):<br>c.2T>C(p.Met1Thr) | GGCCAYGGGCTACCCGGAGGTGG | 741 | Hypohidrotic X-linked<br>ectodermal dysplasia |
| 111033589 NM_021044.2(DHH):<br>c.485T>C<br>(p.Leu162Pro) | GTTGCYGGCGCGCCTCGCAGTGG | 742 | 46, XY gonadal<br>dysgenesis, complete,<br>dhh related |
| 111033622 NM_000206.2(IL2RG):<br>c.343T>C<br>(p.Cys115Arg) | TGGCYGTCAGTTGCAAAAAAAGG | 743 | X-linked severe<br>combined<br>immunodeficiency |
| 121912613 NM_001041.3(SI):<br>c.1859T>C<br>(p.Leu620Pro) | ATGCYGGAGTTCAGTTTGTTTGG | 744 | Sucrase-isomaltase<br>deficiency |
| 121912619 NM_016180.4<br>(SLC45A2):c.1082T>C<br>(p.Leu361Pro) | GAGTTTCYCATCTACGAAAGAGG | 745 | Oculocutaneous<br>albinism type 4 |
| 61750581 NM_000552.3(VWF):<br>c.4837T>C<br>(p.Ser1613Pro) | CTGCCYCTGATGAGATCAAGAGG | 746 | von Willebrand<br>disease, type 2a |
| 121912653 NM_000546.5(TP53):<br>c.755T>C<br>(p.Leu252Pro) | CATCCYCACCATCATCACACTGG | 747 | Li-Fraumeni<br>syndrome 1 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 111033683 | NM_000155.3(GALT): c.386T>C (p.Met129Thr) | AGGTCAYGTGCTTCCACCCCTGG | 748 | Deficiency of UDPglucose-hexose-1-phosphate uridylyltransferase |
| 111033752 | NM_000155.3(GALT): c.677T>C (p.Leu226Pro) | CAGGAGCYACTCAGGAAGGTGGG | 749 | Deficiency of UDPglucose-hexose-1-phosphate uridylyltransferase |
| 121912729 | NM_000039.1(APOA1): c.593T>C (p.Leu198Ser) | GCGCTYGGCCGCGCGCCTTGAGG | 750 | Familial visceral amyloidosis, Ostertag type |
| 769452 | NM_000041.3(APOE): c.137T>C (p.Leu46Pro) | AACYGGCACTGGGTCGCTTTTGG | 751 | |
| 121912762 | NM_016124.4(RHD): c.329T>C (p.Leu110Pro) | ACACYGTTCAGGTATTGGGATGG | 752 | |
| 111033824 | NM_000155.3(GALT): c.1138T>C (p.Ter380Arg) | CGCCYGACCACGCCGACCACAGG, GCCYGACCACGCCGACCACAGGG | 753 754 | Deficiency of UDPglucose-hexose-1-phosphate uridylyltransferase |
| 111033832 | NM_000155.3(GALT): c.980T>C (p.Leu327Pro) | TCCYGCGCTCTGCCACTGTCCGG | 755 | Deficiency of UDPglucose-hexose-1-phosphate uridylyltransferase |
| 730881974 | NM_000455.4(STK11): c.545T>C (p.Leu182Pro) | GGGAACCYGCTGCTCACCACCGG, AACCYGCTGCTCACCACCGGTGG | 756 757 | Hereditary cancer-predisposing syndrome |
| 1064644 | NM_000157.3(GBA): c.703T>C (p.Ser235Pro) | GGGYCACTCAAGGGACAGCCCGG | 758 | Gaucher disease |
| 796052090 | NM_138413.3(HOGA1): c.533T>C (p.Leu178Pro) | GGACCYGCCTGTGGATGCAGTGG | 759 | Primary hyperoxaluria, type III |
| 121913141 | NM_000208.2(INSR): c.779T>C (p.Leu260Pro) | CTACCYGGACGGCAGGTGTGTGG | 760 | Leprechaunism syndrome |
| 121913272 | NM_006218.2(PIK3CA): c.1258T>C (p.Cys420Arg) | GGAACACYGTCCATTGGCATGGG, GAACACYGTCCATTGGCATGGGG | 761 762 | Congenital lipomatous overgrowth, vascular malformations, and epidermal nevi, Neoplasm of ovary, PIK3CA Related Overgrowth Spectrum |
| 61751310 | NM_000552.3(VWF): c.8317T>C (p.Cys2773Arg) | GCTCCYGCTGCTCTCCGACACGG | 763 | von Willebrand disease, type 2a |
| 312262799 | NM_024408.3(NOTCH2): c.1438T>C (p.Cys480Arg) | TTCACAYGTCTGTGCATGCCAGG | 764 | Alagille syndrome 2 |
| 121913570 | NM_000426.3(LAMA2): c.7691T>C (p.Leu2564Pro) | ATCATTCYTTTGGGAAGTGGAGG, TCATTCYTTTGGGAAGTGGAGGG | 765 766 | Merosin deficient congenital muscular dystrophy |
| 121913640 | NM_000257.3(MYH7): c.1046T>C (p.Met349Thr) | AACTCCAYGTATAAGCTGACAGG | 767 | Familial hypertrophic cardiomyopathy 1, Cardiomyopathy |
| 121913642 | NM_000257.3(MYH7): c.1594T>C (p.Ser532Pro) | CATCATGYCCATCCTGGAAGAGG | 768 | Dilated cardiomyopathy 1S |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 119463996 | NM_001079802.1(FKTN):<br>c.527T>C<br>(p.Phe176Ser) | GTAGTCTYTCATGAGAGGAGTGG | 769 | Limb-girdle<br>muscular dystrophy<br>dystroglycanopathy,<br>type C4 |
| 587776456 | NM_002049.3(GATA1):<br>c.1240T>C<br>(p.Ter414Arg) | GCTCAYGAGGGCACAGAGCATGG | 770 | GATA-1-related<br>thrombocytopenia with<br>dyserythropoiesis |
| 63750654 | NM_000184.2(HBG2):<br>c.-228T>C | ATGCAAAYATCTGTCTGAAACGG | 771 | Fetal hemoglobin<br>quantitative trait<br>locus 1 |
| 587776519 | NM_001999.3(FBN2):<br>c.3725-15A>G | AGCAYTGCAACCACATTGTCAGG | 772 | Congenital<br>contractural<br>arachnodactyly |
| 78365220 | NM000402.4(G6PD):<br>c.47-3T>C<br>(p.Leu158Pro) | TGCCCYCCACCTGGGGTCACAGG | 773 | Anemia, nonspherocytic<br>hemolytic, due to<br>G6PD deficiency |
| 63750741 | NM_000179.2(MSH6):<br>c.1346T>C<br>(p.Leu449Pro) | CTGGGGCYGGTATTCATGAAAGG | 774 | Hereditary<br>Nonpolyposis<br>Colorectal<br>Neoplasms |
| 587776914 | NM_017565.3(FAM20A):<br>c.590-2A>G | GTAATCYGCAAAGGAGGAGAAGG,<br>TAATCYGCAAAGGAGGAGAAGGG | 775<br>776 | Enamel-renal syndrome |
| 5030809 | NM_000551.3(VHL):<br>c.292T>C<br>(p.Tyr98His) | CCCYACCCAACGCTGCCGCCTGG | 777 | Von Hippel-Lindau<br>syndrome, Hereditary<br>cancer-predisposing<br>syndrome |
| 199476132 | m.5728T>C | CAATCYACTTCTCCCGCCGCCGG,<br>AATCYACTTCTCCCGCCGCCGGG | 778<br>779 | Cytochrome-c oxidase<br>deficiency,<br>Mitochondrial complex<br>I deficiency |
| 62637012 | NM_014336.4(AIPL1):<br>c.715T>C<br>(p.Cys239Arg) | CTGCCAGYGCCTGCTGAAGAAGG,<br>CCAGYGCCTGCTGAAGAAGGAGG | 780<br>781 | Leber congenital<br>amaurosis 4 |
| 199476199 | NM_207352.3(CYP4V2):<br>c.1021T>C<br>(p.Ser341Pro) | AAACTGGYCCTTATACCTGTTGG,<br>AACTGGYCCTTATACCTGTTGGG | 782<br>783 | Bietti crystalline<br>corneoretinal<br>dystrophy |
| 587777183 | NM_006702.4(PNPLA6):<br>c.3053T>C<br>(p.Phe1018Ser) | CCTYTAACCGCAGCATCCATCGG | 784 | Boucher Neuhauser<br>syndrome |
| 199476389 | NM000487.5(ARSA):<br>c.89-9T>C<br>(p.Leu300Ser) | GGTCTCTYGCGGTGTGGAAAGGG | 785 | Metachromatic<br>leukodystrophy |
| 199476398 | NM_016599.4(MYOZ2):<br>c.142T>C<br>(p.Ser48Pro) | TTAYCCCATCTCAGTAACCGTGG | 786 | Familial hypertrophic<br>cardiomyopathy 16 |
| 119456967 | NM_001037633.1(SIL1):<br>c.1370T>C<br>(p.Leu457Pro) | TTGCYGAAGGAGCTGAGATGAGG | 787 | Marinesco-<br>Sj\xc3\xb6gren<br>syndrome |
| 730882253 | NM_006888.4(CALM1):<br>c.268T>C<br>(p.Phe90Leu) | GGCAYTCCGAGTCTTTGACAAGG | 788 | Long QT syndrome 14 |
| 587777283 | NM_012338.3(TSPAN12):<br>c.413A>G<br>(p.Tyr138Cys) | TAATCCAYAATTTGTCATCCTGG | 789 | Exudative<br>vitreoretinopathy 5 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 587777306 | NM_015884.3(MBTPS2): c.1391T>C (p.Phe464Ser) | GCTYTGCTTTGGATGGACAATGG | 790 | Palmoplantar keratoderma, mutilating, with periorificial keratotic plaques, X-linked |
| 56378716 | NM_000250.1(MPO): c.752T>C (p.Met251Thr) | TCACTCAYGTTCATGCAATGGGG | 791 | Myeloperoxidase deficiency |
| 587777390 | NM_005026.3(PIK3CD): c.1246T>C (p.Cys416Arg) | GCAGGACYGCCCCATTGCCTGGG | 792 | Activated PI3K-delta syndrome |
| 587777480 | NM_003108.3(SOX11): c.178T>C (p.Ser60Pro) | TATGGYCCAAGATCGAACGCAGG | 793 | Mental retardation, autosomal dominant 27 |
| 587777663 | NM_001288767.1 (ARMC5):c.1379T>C (p.Leu460Pro) | GCCCGACYGCGGGATGCTGGTGG | 794 | Acth-independent macronodular adrenal hyperplasia 2 |
| 61753033 | NM_000350.2(ABCA4): c.5819T>C (p.Leu1940Pro) | AAGGCYACATGAACTAACCAAGG | 795 | Stargardt disease, Stargardt disease 1, Conerod dystrophy 3 |
| 200488568 | NM_002972.3(SBF1): c.4768A>G (p.Thr1590Ala) | CAGGCGYCCTCTTGCTCAGCCGG | 796 | Charcot-Marie-Tooth disease, type 4B3 |
| 132630274 | NM_000377.2(WAS): c.809T>C (p.Leu270Pro) | CGGAGTCYGTTCTCCAGGGCAGG | 797 | Severe congenital neutropenia X-linked |
| 132630308 | NM_001399.4(EDA): c.181T>C(p.Tyr61His) | CTGCYACCTAGAGTTGCGCTCGG | 798 | Hypohidrotic X-linked ectodermal dysplasia |
| 60934003 | NM_170707.3(LMNA): c.1589T>C (p.Leu530Pro) | ACGGCTCYCATCAACTCCACTGG, CGGCTCYCATCAACTCCACTGGG, GGCTCYCATCAACTCCACTGGGG | 799 800 801 | Benign scapuloperoneal muscular dystrophy with cardiomyopathy |
| 180177160 | NM_000030.2(AGXT): c.1076T>C (p.Leu359Pro) | GGTGCYGCGGATCGGCCTGCTGG, GTGCYGCGGATCGGCCTGCTGGG | 802 803 | Primary hyperoxaluria, type I |
| 180177222 | NM_000030.2(AGXT): c.449T>C (p.Leu150Pro) | GTGCYGCTGTTCTTAACCCACGG, TGCYGCTGTTCTTAACCCACGGG | 804 805 | Primary hyperoxaluria, type I |
| 180177254 | NM_000030.2(AGXT): c.661T>C (p.5er221Pro) | GCTCATCYCCTTCAGTGACAAGG | 806 | Primary hyperoxaluria, type I |
| 180177264 | NM_000030.2(AGXT): c.757T>C (p.Cys253Arg) | GGGGCYGTGACGACCAGCCCAGG | 807 | Primary hyperoxaluria, type I |
| 180177293 | NM_000030.2(AGXT): c.893T>C (p.Leu298Pro) | GTATCYGCATGGGCGCCTGCAGG | 808 | Primary hyperoxaluria, type I |
| 376785840 | NM_001282227.1 (CECR1):c.1232A>G (p.Tyr411Cys) | GAAATCAYAGGACAAGCCTTTGG | 809 | Polyarteritis nodosa |
| 587779393 | NM_000257.3(MYH7): c.4937T>C (p.Leu1646Pro) | GAGCCYCCAGAGCTTGTTGAAGG | 810 | Myopathy, distal, 1 |
| 587779410 | NM_012434.4(SLC17A5): c.500T>C (p.Leu167Pro) | ATTGTACYCAGAGCACTAGAAGG | 811 | Sialic acid storage disease, severe infantile type |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 587779513 | NM_000090.3(COL3A1): c.2337 + 2T>C (p.Gly762_Lys779del) | AGGYAACCCTTAATACTACCTGG | 812 | Ehlers-Danlos syndrome, type 4 |
| 777539013 | NM_020376.3(PNPLA2): c.757 + 2T>C | GAACGGYGCGCGGACCCGGGCGG, AACGGYGCGCGGACCCGGGCGGG | 813 814 | Neutral lipid storage disease with myopathy |
| 34557412 | NM_012452.2 (TNFRSF13B):c.310T>C (p.Cys104Arg) | ACTTCYGTGAGAACAAGCTCAGG | 815 | Immunoglobulin A deficiency 2, Common variable immunodeficiency 2 |
| 796052970 | NM_001165963.1 (SCN1A):c.1094T>C (p.Phe365Ser) | CAAGCTYTGATACCTTCAGTTGG, AAGCTYTGATACCTTCAGTTGGG | 816 817 | not provided |
| 724159989 | NC_012920.1:m.7505 T>C | CCTCCAYGACTTTTTCAAAAAGG | 818 | Deafness, nonsyndromic sensorineural, mitochondrial |
| 796053222 | NM_014191.3(SCN8A): c.4889T>C (p.Leu1630Pro) | CGTCYGATCAAAGGCGCCAAAGG, GTCYGATCAAAGGCGCCAAAGGG | 819 820 | not provided |
| 118192127 | NM_000540.2(RYR1): c.10817T>C (p.Leu3606Pro) | TACTACCYGGACCAGGTGGGTGG, ACTACCYGGACCAGGTGGGTGGG, CTACCYGGACCAGGTGGGTGGGG | 821 822 823 | Central core disease |
| 118192170 | NM_000540.2(RYR1): c.14693T>C (p.Ile4898Thr) | AGGCAYTGGGGACGAGATCGAGG | 824 | Malignant hyperthermia susceptibility type 1, Central core disease |
| 121917703 | NM_005247.2(FGF3): c.466T>C (p.Ser156Pro) | GTACGTGYCTGTGAACGGCAAGG, TACGTGYCTGTGAACGGCAAGGG | 825 826 | Deafness with labyrinthine aplasia microtia and microdontia (LAMM) |
| 690016549 | NM_005211.3(CSF1R): c.2450T>C (p.Leu817Pro) | CCGCCYGCCTGTGAAGTGGATGG | 827 | Hereditary diffuse leukoencephalopathy with spheroids |
| 690016552 | NM_005211.3(CSF1R): c.2566T>C (p.Tyr856His) | GAATCCCYACCCTGGCATCCTGG | 828 | Hereditary diffuse leukoencephalopathy with spheroids |
| 121917738 | NM_001098668.2 (SFTPA2):c.593T>C (p.Phe198Ser) | GGAGACTYCCGCTACTCAGATGG, GAGACTYCCGCTACTCAGATGGG | 829 830 | Idiopathic fibrosing alveolitis, chronic form |
| 690016559 | NM_005211.3(CSF1R): c.1957T>C (p.Cys653Arg) | AGCCYGTACCCATGGAGGTAAGG, GCCYGTACCCATGGAGGTAAGGG | 831 832 | Hereditary diffuse leukoencephalopathy with spheroids |
| 690016560 | NM_005211.3(CSF1R): c.2717T>C (p.Ile906Thr) | GCAGAYCTGCTCCTTCCTTCAGG | 833 | Hereditary diffuse leukoencephalopathy with spheroids |
| 121917769 | NM_003361.3(UMOD): c.376T>C (p.Cys126Arg) | GGCCACAYGTGTCAATGTGGTGG, GCCACAYGTGTCAATGTGGTGGG | 834 835 | Familial juvenile gout |
| 121917773 | NM_003361.3(UMOD): c.943T>C (p.Cys315Arg) | ATGGCACYGCCAGTGCAAACAGG | 836 | Glomerulocystic kidney disease with hyperuricemia and isosthenuria |
| 121917818 | NM_007255.2(B4GALT7): c.617T>C (p.Leu206Pro) | TGCYCTCCAAGCAGCACTACCGG | 837 | Ehlers-Danlos syndrome progeroid type |
| 121917824 | NM_021615.4(CHST6): c.827T>C (p.Leu276Pro) | GGACCYGGCGCGGGAGCCGCTGG | 838 | Macular corneal dystrophy Type 1 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121917848 | NM_000452.2(SLC10A2): c.728T>C (p.Leu243Pro) | TTTCYTCTGGCTAGAATTGCTGG | 839 | Bile acid malabsorption, primary |
| 121918006 | NM_000478.4(ALPL): c.1306T>C (p.Tyr436His) | TGGACYATGGTGAGACCTCCAGG | 840 | Infantile hypophosphatasia |
| 121918010 | NM_000478.4(ALPL): c.979T>C (p.Phe327Leu) | CAAAGGCYTCTTCTTGCTGGTGG, GGCYTCTTCTTGCTGGTGGAAGG | 841 842 | Infantile hypophosphatasia |
| 121918088 | NM_000371.3(TTR): c.400T>C(p.Tyr134His) | CCCCYACTCCTATTCCACCACGG | 843 | |
| 121918110 | NM_001042465.1(PSAP): c.1055T>C (p.Leu352Pro) | GAAGCYGCCGAAGTCCCTGTCGG | 844 | Gaucher disease, atypical, due to saposin C deficiency |
| 121918137 | NM_003730.4(RNASET2): c.550T>C (p.Cys184Arg) | CCAGYGCCTTCCACCAAGCCAGG | 845 | Leukoencephalopathy, cystic, without megalencephaly |
| 121918191 | NM_001127628.1 (FBP1):c.581T>C (p.Phe194Ser) | GGAGTYCATTTTGGTGGACAAGG | 846 | Fructose- biphosphatase deficiency |
| 121918306 | NM_006946.2(SPTBN2): c.758T>C (p.Leu253Pro) | ACCAAGCYGCTGGATCCCGAAGG, AAGCYGCTGGATCCCGAAGGTGG, AGCYGCTGGATCCCGAAGGTGGG | 847 848 849 | Spinocerebellar ataxia 5 |
| 121918505 | NM_000141.4(FGFR2): c.799T>C (p.Ser267Pro) | AATGCCYCCACAGTGGTCGGAGG | 850 | Pfeiffer syndrome, Neoplasm of stomach |
| 121918643 | NM_003126.2(SPTA1): c.620T>C (p.Leu207Pro) | GTGGAGCYGGTAGCTAAAGAAGG, TGGAGCYGGTAGCTAAAGAAGGG | 851 852 | Hereditary pyropoikilocytosis, Elliptocytosis 2 |
| 121918646 | NM_001024858.2 (SPTB):c.604T>C (p.Trp202Arg) | CTCCAGCYGGAAGGATGGCTTGG | 853 | Spherocytosis type 2 |
| 121918648 | NM_001024858.2 (SPTB):c.6055T>C (p.Ser2019Pro) | ATGCCYCTGTGGCTGAGGCGTGG | 854 | |
| 727504166 | NM_000543.4(SMPD1): c.475T>C (p.Cys159Arg) | TGAGGCCYGTGGCCTGCTCCTGG, GAGGCCYGTGGCCTGCTCCTGGG | 855 856 | Niemann-Pick disease, type A, Niemann-Pick disease, type B |
| 193922915 | NM_000434.3(NEU1): c.1088T>C (p.Leu363Pro) | CAGCYATGGCCAGGCCCCAGTGG | 857 | Sialidosis, type II |
| 727504419 | NM_000501.3(ELN): c.889 + 2T>C | CAGGYAACATCTGTCCCAGCAGG, AGGYAACATCTGTCCCAGCAGGG | 858 859 | Supravalvar aortic stenosis |
| 376395543 | NM_000256.3(MYBPC3): c.26-2A>G | GAGACYGAAGGGCCAGGTGGAGG | 860 | Primary familial hypertrophic cardiomyopathy, Familial hypertrophic cardiomyopathy 4, Cardiomyopathy |
| 1169305 | NM_000545.6(HNF1A): c.1720G>A (p.Gly574Ser) | GATGCYGGCAGGGTCCTGGCTGG, ATGCYGGCAGGGTCCTGGCTGGG, TGCYGGCAGGGTCCTGGCTGGGG | 861 862 863 | Maturity-onset diabetes of the young, type 3 |
| 730880130 | NM_000527.4(LDLR): c.1468T>C (p.Trp490Arg) | CTACYGGACCGACTCTGTCCTGG, TACYGGACCGACTCTGTCCTGGG | 864 865 | Familial hypercholesterolemia |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 281860286 | NM_018713.2(SLC30A10): c.500T>C (p.Phe167Ser) | GGCGCTTYCGGGGGGCCTCAGGG | 866 | Hypermanganesemia with dystonia, polycythemia and cirrhosis |
| 730880306 | NM_145693.2(LPIN1): c.1441 + 2T>C | AAGGYACCGCGGGCCTCGCGCGG, AGGYACCGCGGGCCTCGCGCGGG | 867 868 | Myoglobinuria, acute recurrent, autosomal recessive |
| 74315452 | NM_000454.4(SOD1): c.338T>C (p.Ile113Thr) | TTGCAYCATTGGCCGCACACTGG | 869 | Amyotrophic lateral sclerosis type 1 |
| 730880455 | NM_000169.2(GLA): c.41T>C(pleu14Pro) | CGCGCYTGCGCTTCGCTTCCTGG | 870 | not provided |
| 267606656 | NM_054027.4(ANKH): c.1015T>C (p.Cys339Arg) | AGCTCYGTTTCGTGATGTTTTGG | 871 | Craniometaphyseal dysplasia, autosomal dominant |
| 267606687 | NM_033409.3(SLC52A3): c.1238T>C (p.Val413Ala) | AGTTACGYCAAGGTGATGCTGGG | 872 | Brown-Vialetto-Van laere syndrome |
| 267606721 | NM_001928.2(CFD): c.640T>C (p.Cys214Arg) | GGTGYGCGGGGGCGTGCTCGAGG, GTGYGCGGGGGCGTGCTCGAGGG | 873 874 | Complement factor d deficiency |
| 267606747 | NM_001849.3(COL6A2): c.2329T>C (p.Cys777Arg) | CGCCYGCGACAAGCCACAGCAGG | 875 | Ullrich congenital muscular dystrophy |
| 431905515 | NM_001044.4(SLC6A3): c.671T>C (p.Leu224Pro) | CTGCACCYCCACCAGAGCCATGG | 876 | Infantile Parkinsonism-dystonia |
| 267606857 | NM_000180.3(GUCY2D): c.2846T>C (p.Ile949Thr) | AGAGAYCGCCAACATGTCACTGG | 877 | Cone-rod dystrophy 6 |
| 267606880 | NM_022489.3(INF2): c.125T>C(p.Leu42Pro) | GCTGCYCCAGATGCCCTCTGTGG | 878 | Focal segmental glomerulosclerosis 5 |
| 515726191 | NM_015713.4(RRM2B): c.581A>G (p.Glu194Gly) | AACTCCTYCTACAGCAGCAAAGG | 879 | RRM2B-related mitochondrial disease |
| 267606917 | NM_004646.3(NPHS1): c.793T>C (p.Cys265Arg) | GCTGCCGYGCGTGGCCCGAGGGG, CTGCCGYGCGTGGCCCGAGGGGG | 880 881 | Finnish congenital nephrotic syndrome |
| 267607104 | NM_001199107.1 (TBC1D24):c.751T>C (p.Phe251Leu) | CAAGTTCYTCCACAAGGTGAGGG, TTCYTCCACAAGGTGAGGGCCGG | 882 883 | Myoclonic epilepsy, familial infantile |
| 267607182 | NM_144631.5(ZNF513): c.1015T>C (p.Cys339Arg) | TGGGCGCYGCATGCGAGGAGAGG, CGCYGCATGCGAGGAGAGGCTGG | 884 885 | Retinitis pigmentosa 58 |
| 267607211 | NM_000229.1(LCAT): c.508T>C (p.Trp170Arg) | TATGACYGGCGGCTGGAGCCCGG | 886 | Norum disease |
| 267607215 | NM_016269.4(LEF1): c.181T>C(p.Ser61Pro) | GAACGAGYCTGAAATCATCCCGG | 887 | Sebaceous tumors, somatic |
| 587783580 | NM_178151.2(DCX): c.683T>C (p.Leu228Pro) | AAAAAACYCTACACTCTGGATGG | 888 | Heterotopia |
| 587783644 | NM_004004.5(GJB2): c.107T>C (p.Leu36Pro) | GATCCYCGTTGTGGCTGCAAAGG | 889 | Hearing impairment |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 587783653 | NM_005682.6(ADGRG1): c.1460T>C (p.Leu487Pro) | CCCTGCYCACCTGCCTTTCCTGG | 890 | Polymicrogyria, bilateral frontoparietal |
| 587783863 | NM_000252.2(MTM1): c.958T>C (p.Ser320Pro) | GGAAYCTTTAAAAAAAGTGAAGG | 891 | Severe X-linked myotubular myopathy |
| 267607751 | NM_000249.3(MLH1): c.453 + 2T>C | ATCACGGYAAGAATGGTACATGG, TCACGGYAAGAATGGTACATGGG | 892 893 | Hereditary Nonpolyposis Colorectal Neoplasms |
| 119103227 | NM_000411.6(HLCS): c.710T>C (p.Leu237Pro) | CTATCYTTCTCAGGGAGGGAAGG | 894 | Holocarboxylase synthetase deficiency |
| 119103237 | NM_005787.5(ALG3): c.211T>C (p.Trp71Arg) | GATTGACYGGAAGGCCTACATGG | 895 | Congenital disorder of glycosylation type 1D |
| 398122806 | NM_003172.3(SURF1): c.679T>C (p.Trp227Arg) | CCACYGGCATTATCGAGACCTGG | 896 | Congenital myasthenic syndrome, acetazolamide-responsive |
| 80338747 | NM_004525.2(LRP2): c.7564T>C (p.Tyr2522His) | GTACCTGYACTGGGCTGACTGGG | 897 | Donnai Barrow syndrome |
| 398122838 | NM_001271723.1 (FBXO38):c.616T>C (p.Cys206Arg) | TTCCTYGTATCCCAATGCTAAGG | 898 | Distal hereditary motor neuronopathy 2D |
| 398122989 | NM_014495.3(ANGPTL3): c.883T>C (p.Phe295Leu) | ACAAAACYTCAATGAAACGTGGG | 899 | Hypobetalipo-proteinemia, familial, 2 |
| 80338945 | NM_004004.5(GJB2): c.269T>C (p.Leu90Pro) | GCTCCYAGTGGCCATGCACGTGG | 900 | Deafness, autosomal recessive 1A, Hearing impairment |
| 80338956 | NM_000334.4(SCN4A): c.2078T>C (p.Ile693Thr) | AAGATCAYTGGCAATTCAGTGGG, AGATCAYTGGCAATTCAGTGGGG, GATCAYTGGCAATTCAGTGGGGG | 901 902 903 | Hyperkalemic Periodic Paralysis Type 1, Paramyotonia congenita of von Eulenburg |
| 267608131 | NM_000179.2(MSH6): c.4001 + 2T>C | CGGYAACTAACTAACTATAATGG | 904 | Hereditary Nonpolyposis Colorectal Neoplasms |
| 587784573 | NM_004963.3(GUCY2C): c.2782T>C (p.Cys928Arg) | TCCCYGTGCTGCTGGAGTTGTGG, CCCYGTGCTGCTGGAGTTGTGGG | 905 906 | Meconium ileus |
| 267608511 | NM_003159.2(CDKL5): c.659T>C (p.Leu220Pro) | CCAACYTTTTACTATTCAGAAGG | 907 | Early infantile epileptic encephalopathy 2 |
| 373842615 | NM_000118.3(ENG): c.1273-2A>G | CCGCCYGCGGGGATAAAGCCAGG, CGCCYGCGGGGATAAAGCCAGGG | 908 909 | Haemorrhagic telangiectasia 1 |
| 185492581 | NM_000335.4(SCN5A): c.376A>G (p.Lys126Glu) | GAATCTYCACAGCCGCTCTCCGG | 910 | Brugada syndrome |
| 200533370 | NM_133499.2(SYN1): c.1699A>G (p.Thr567Ala) | GATGYCTGACGGGTAGCCTGTGG, ATGYCTGACGGGTAGCCTGTGGG | 911 912 | Epilepsy, X-linked, with variable learning disabilities and behavior disorders, not specified |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 118203981 | NM_148960.2(CLDN19): c.269T>C (p.Leu90Pro) | GCTCCYGGGCTTCGTGGCCATGG | 913 | Hypomagnesemia 5, renal, with ocular involvement |
| 137853892 | NM_001235.3 (SERPINH1):c.233T>C (p.Leu78Pro) | GTCGCYAGGGCTCGTGTCGCTGG, TCGCYAGGGCTCGTGTCGCTGGG | 914 915 | Osteogenesis imperfecta type 10 |
| 118204024 | NM_000263.3(NAGLU): c.142T>C (p.Phe48Leu) | GGCCGACYTCTCCGTGTCGGTGG | 916 | Mucopolysaccharidosis, MPS-III-B |
| 690016563 | NM_005211.3(CSF1R): c.1745T>C (p.Leu582Pro) | CAACCYGCAGTTTGGTGAGATGG | 917 | Hereditary diffuse leukoencephalopathy with spheroids |
| 58380626 | NM_000526.4(KRT14): c.1243T>C (p.Tyr415His) | CGCCACCYACCGCCGCCTGCTGG, CACCYACCGCCGCCTGCTGGAGG, ACCYACCGCCGCCTGCTGGAGGG | 918 919 920 | Epidermolysis bullosa herpetiformis, Dowling-Meara |
| 113994151 | NM_207346.2(TSEN54): c.277T>C (p.Ser93Pro) | TTGAAGYCTCCCGCGGTGAGCGG, AAGYCTCCCGCGGTGAGCGGCGG | 921 922 | Pontocerebellar hypoplasia type 4 |
| 113994206 | NM_004937.2(CTNS): c.473T>C (p.Leu158Pro) | TGGTCYGAGCTTCGACTTCGTGG | 923 | Cystinosis |
| 62516109 | NM_000277.1(PAH): c.638T>C (p.Leu213Pro) | CCACTTCYTGAAAAGTACTGTGG | 924 | Phenylketonuria |
| 370011798 | NM_001302946.1 (TRNT1):c.668T>C (p.Ile223Thr) | GCAAYTGCAGAAAATGCAAAAGG | 925 | Sideroblastic anemia with B-cell immunodeficiency, periodic fevers, and developmental delay |
| 62517167 | NM_000277.1(PAH): c.293T>C(p.Leu98Ser) | AAGATCTYGAGGCATGACATTGG | 926 | Mild non-PKU hyperphenylalanemia |
| 12021720 | NM_001918.3(DBT): c.1150G>A (p.Gly384Ser) | GACYCACAGAGCCCAATTTCTGG | 927 | Intermediate maple syrup urine disease type 2 |
| 104886289 | NM_000495.4(COL4A5): c.4756T>C (p.Cys1586Arg) | TCCCCATYGTCCTCAGGGATGGG | 928 | Alport syndrome, X-linked recessive |
| 370471013 | NC_012920.1:m.5559 A>G | CAACYTACTGAGGGCTTTGAAGG | 929 | Leigh disease |
| 121434215 | NM_000487.5(ARSA): c.410T>C (p.Leu137Pro) | GCCTTCCYGCCCCCCCATCAGGG | 930 | Metachromatic leukodystrophy, adult type |
| 386134128 | NM_000096.3(CP): c.1123T>C (p.Tyr375His) | ACACTACYACATTGCCGCTGAGG | 931 | Deficiency of ferroxidase |
| 121434275 | NM_001127328.2 (ACADM):c.1136T>C (p.Ile379Thr) | GTGCAGAYACTTGGAGGCAATGG | 932 | Medium-chain acyl-coenzyme A dehydrogenase deficiency |
| 121434276 | NM_001127328.2 (ACADM):c.742T>C (p.Cys248Arg) | CAGCGAYGTTCAGATACTAGAGG | 933 | Medium-chain acyl-coenzyme A dehydrogenase deficiency |
| 121434284 | NM_002225.3(IVD): c.134T>C(p.Leu45Pro) | ATGGGCYAAGCGAGGAGCAGAGG | 934 | ISOVALERIC ACIDEMIA, TYPE 1 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121434334 | NM_005908.3(MANBA):<br>c.1513T>C<br>(p.Ser505Pro) | ATTACGYCCAGTCCTACAAATGG,<br>TTACGYCCAGTCCTACAAATGGG,<br>TACGYCCAGTCCTACAAATGGGG | 935<br>936<br>937 | Beta-D-<br>mannosidosis |
| 121434366 | NM_000159.3(GCDH):<br>c.883T>C<br>(p.Tyr295His) | CGCCCGGYACGGCATCGCGTGGG,<br>GCCCGGYACGGCATCGCGTGGGG | 938<br>939 | Glutaric aciduria,<br>type 1 |
| 60715293 | NM_000424.3(KRT5):<br>c.541T>C<br>(p.Ser181Pro) | GTTTGCCYCCTTCATCGACAAGG | 940 | Epidermolysis<br>bullosa<br>herpetiformis,<br>Dowling-Meara |
| 121434409 | NM_001003722.1<br>(GLE1):c.2051T>C<br>(p.Ile684Thr) | AAGGACAYTCCTGTCCCCAAGGG | 941 | Lethal<br>arthrogryposis<br>with anterior<br>horn cell disease |
| 121434434 | NM_001287.5(CLCN7):<br>c.2297T>C<br>(p.Leu766Pro) | GGGCCYGCGGCACCTGGTGGTGG | 942 | Osteopetrosis<br>autosomal<br>recessive 4 |
| 121434455 | NM_000466.2(PEX1):<br>c.1991T>C<br>(p.Leu664Pro) | GATGACCYTGACCTCATTGCTGG | 943 | Zellweger syndrome |
| 199422317 | NM_001099274.1<br>(TINF2):c.862T>C<br>(p.Phe288Leu) | CTGYTTCCCTTTAGGAATCTCGG | 944 | Aplastic anemia |
| 104895221 | NM_001065.3<br>(TNFRSF1A):c.349T>C<br>(p.Cys117Arg) | CTCTTCTYGCACAGTGGACCGGG | 945 | TNF receptor-<br>associated periodic<br>fever syndrome<br>(TRAPS) |
| 137854459 | NM_000138.4(FBN1):<br>c.4987T>C<br>(p.Cys1663Arg) | GGGACAYGTTACAACACCGTTGG | 946 | Marfan syndrome |
| 387907075 | NM_024027.4(COLEC11):<br>c.505T>C<br>(p.Ser169Pro) | CAGCTGYCCTGCCAGGGCCGCGG,<br>AGCTGYCCTGCCAGGGCCGCGGG,<br>GCTGYCCTGCCAGGGCCGCGGGG,<br>CTGYCCTGCCAGGGCCGCGGGGG | 947<br>948<br>949<br>950 | Carnevale syndrome |
| 1048095 | NM_000352.4(ABCC8):<br>c.674T>C<br>(p.Leu225Pro) | TGCYGTCCAAAGGCACCTACTGG | 951 | Permanent neonatal<br>diabetes mellitus |
| 796065347 | NM_019074.3(DLL4):<br>c.1168T>C<br>(p.Cys390Arg) | GAAYGTCCCCCCAACTTCACCGG | 952 | Adams-Oliver syndrome,<br>ADAMS-OLIVER<br>SYNDROME 6 |
| 137852347 | NM_000402.4(G6PD):<br>c.1054T>C<br>(p.Tyr352His) | AGGGYACCTGGACGACCCCACGG | 953 | Anemia,<br>nonspherocytic<br>hemolytic, due to<br>G6PD deficiency |
| 74315327 | NM_213653.3(HFE2):<br>c.302T>C<br>(p.Leu101Pro) | GGACCYCGCCTTCCATTCGGCGG | 954 | Hemochromatosis type<br>2A |
| 137852579 | NM_000044.3(AR):<br>c.2033T>C<br>(p.Leu678Pro) | GTCCYGGAAGCCATTGAGCCAGG | 955 | |
| 137852636 | NM_001166107.1<br>(HMGCS2):c.520T>C<br>(p.Phe174Leu) | CCCTCYTCAATGCTGCCAACTGG | 956 | mitochondrial<br>3-hydroxy-3-methyl-<br>glutaryl-CoA<br>synthase deficiency |
| 137852661 | NM_033163.3(FGF8):<br>c.118T>C<br>(p.Phe40Leu) | TTCCCTGYTCCGGGCTGGCCGGG | 957 | Kallmann syndrome 6 |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121912967 NM_005215.3(DCC): c.503T>C (p.Met168Thr) | AGCCCAYGCCAACAATCCACTGG | 958 | |
| 137852806 NM_001039523.2 (CHRNA1):c.901T>C (p.Phe301Leu) | TGTGYTCCTTCTGGTCATCGTGG | 959 | Myasthenic syndrome, congenital, fast-channel |
| 137852850 NM_182760.3(SUMF1): c.463T>C (p.Ser155Pro) | GGCGACYCCTTTGTCTTTGAAGG | 960 | Multiple sulfatase deficiency |
| 137852886 NM000158.3(GBE1): c.671T>C (p.Leu224Pro) | AATGTACYACCAAGAATCAAAGG | 961 | Glycogen storage disease, type IV, GLYCOGEN STORAGE DISEASE IV, NONPROGRESSIVE HEPATIC |
| 137852911 NM_000419.3(ITGA2B): c.641T>C (p.Leu214Pro) | CTGGTGCYTGGGGCTCCTGGCGG | 962 | Glanzmann thrombasthenia |
| 137852948 NM_138694.3(PKHD1): c.10658T>C (p.Ile3553Thr) | GAGCCCAYTGAAATACGCTCAGG | 963 | Polycystic kidney disease, infantile type |
| 137852964 NM_024960.4(PANK2): c.178T>C (p.Ser60Pro) | ATTGACYCAGTCGGATTCAATGG | 964 | |
| 137853020 NM_006899.3(IDH3B): c.395T>C (p.Leu132Pro) | TGCGGCYGAGGTAGGTGGTCTGG, GCGGCYGAGGTAGGTGGTCTGGG | 965 966 | Retinitis pigmentosa 46 |
| 137853249 NM_033500.2(HK1): c.1550T>C (p.Leu5175er) | GACTTCTYGGCCCTGGATCTTGG, TTCTYGGCCCTGGATCTTGGAGG | 967 968 | Hemolytic anemia due to hexokinase deficiency |
| 137853270 NM_000444.5(PHEX): c.1664T>C (p.Leu555Pro) | AGCYCCAGAAGCCTTTCTTTTGG | 969 | Familial X-linked hypophosphatemic vitamin D refractory rickets |
| 137853325 NM_003639.4(IKBKG): c.1249T>C (p.Cys417Arg) | TGGAGYGCATTGAGTAGGGCCGG | 970 | Hypohidrotic ectodermal dysplasia with immune deficiency, Hyper-IgM immunodeficiency, Xlinked, with hypohidrotic ectodermal dysplasia |
| 28932769 NM_002055.4(GFAP): c.1055T>C (p.Leu352Pro) | GGACCYGCTCAATGTCAAGCTGG | 971 | Alexander disease |
| 397507439 NM_002769.4(PRSS1): c.116T>C (p.Val39Ala) | TACCAGGYGTCCCTGAATTCTGG | 972 | Hereditary pancreatitis |
| 387906446 NM_000132.3(F8): c.1729T>C (p.Ser577Pro) | AAAGAAYCTGTAGATCAAAGAGG | 973 | Hereditary factor VIII deficiency disease |
| 387906482 NM_000133.3(F9): c.1031T>C (p.Ile344Thr) | ACGAACAYCTTCCTCAAATTTGG | 974 | Hereditary factor IX deficiency disease |
| 387906508 NM_000131.4(F7): c.983T>C (p.Phe328Ser) | GACGTYCTCTGAGAGGACGCTGG | 975 | Factor VII deficiency |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 387906532 | NM_001040113.1 (MYH11):c.3791T>C (p.Leu1264Pro) | GAAGCYGGAGGCGCAGGTGCAGG | 976 | Aortic aneurysm, familial thoracic 4 |
| 387906658 | NM_002465.3(MYBPC1): c.2566T>C (p.Tyr856His) | CAAACCYATATCCGCAGAGTTGG | 977 | Distal arthrogryposis type 1B |
| 387906701 | NM_003491.3(NAA10): c.109T>C (p.Ser37Pro) | TGGCCTTYCCTGGCCCCAGGTGG, GGCCTTYCCTGGCCCCAGGTGGG | 978 979 | N-terminal acetyltransferase deficiency |
| 387906717 | NM_000377.2(WAS): c.881T>C (p.Ile294Thr) | GACTTCAYTGAGGACCAGGGTGG, ACTTCAYTGAGGACCAGGGTGGG | 980 981 | Severe congenital neutropenia X-linked |
| 387906809 | NM_000287.3(PEX6): c.1601T>C (p.Leu534Pro) | CTTCYGGGCCGGGACCGTGATGG, TTCYGGGCCGGGACCGTGATGGG | 982 983 | Peroxisome biogenesis disorder 4B |
| 387906965 | NM_024513.3(FYCO1): c.4127T>C (p.Leu1376Pro) | CAGCCYGATCCCCATCACTGTGG | 984 | Cataract, autosomal recessive congenital 2 |
| 387906967 | NM_006147.3(IRF6): c.65T>C (p.Leu22Pro) | GCCYCTACCCTGGGCTCATCTGG | 985 | Van der Woude syndrome, Popliteal pterygium syndrome |
| 387906982 | NM_025132.3(WDR19): c.20T>C (p.Leu7Pro) | TCTCACYGCTAGAAAAGACTTGG | 986 | Asphyxiating thoracic dystrophy 5 |
| 387907072 | NM_032446.2(MEGF10): c.2320T>C (p.Cys774Arg) | GGGCAGYGTACTTGCCGCACTGG | 987 | Myopathy, areflexia, respiratory distress, and dysphagia, early-onset, Myopathy, areflexia, respiratory distress, and dysphagia, early-onset, mild variant |
| 137854499 | NM_005502.3(ABCA1): c.6026T>C (p.Phe2009Ser) | GAGTYCTTTGCCCTTTTGAGAGG | 988 | Familial hypoalphalipo-proteinemia |
| 387907117 | NM_000196.3(HSD11B2): c.1012T>C (p.Tyr338His) | CCGCCGCYATTACCCCGGCCAGG, CGCCGCYATTACCCCGGCCAGGG | 989 990 | Apparent mineralocorticoid excess |
| 387907170 | NM_004453.3(ETFDH): c.1130T>C (p.Leu377Pro) | CCAAAACYCACCTTTCCTGGTGG | 991 | |
| 387907205 | NM_033360.3(KRAS): c.211T>C (p.Tyr71His) | GGACCAGYACATGAGGACTGGGG, CCAGYACATGAGGACTGGGGAGG, CAGYACATGAGGACTGGGGAGGG | 992 993 994 | Cardiofaciocutaneous syndrome 2 |
| 387907240 | NM_024110.4(CARD14): c.467T>C (p.Leu156Pro) | CAGCAGCYGCAGGAGCACCTGGG | 995 | Pityriasis rubra pilaris |
| 387907282 | NM_152296.4(ATP1A3): c.2431T>C (p.Ser811Pro) | TGCCATCYCACTGGCGTACGAGG | 996 | Alternating hemiplegia of childhood 2 |
| 387907361 | NM_005120.2(MED12): c.3493T>C (p.Ser1165Pro) | AGGACYCTGAGCCAGGGGCCCGG | 997 | Ohdo syndrome, X-linked |
| 28933970 | NM006194.3(PAX9): c.62-T>C(p.Leu21Pro) | GGCCGCYGCCCAACGCCATCCGG | 998 | Tooth agenesis, selective, 3 |
| 137854472 | NM_000138.4(FBN1): c.3128A>G (p.Lys1043Arg) | TGCACYTGCCGTGGGTGCAGAGG | 999 | |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 727504261 | NM_000257.3(MYH7): c.2708A>G (p.Glu903Gly) | AGCGCYCCTCAGCATCTGCCAGG | 1000 Cardiomyopathy, not specified |
| 81002853 | NM_000059.3(BRCA2): c.476-2A>G | ACCACYGGGGGTAAAAAAAGGGG, TACCACYGGGGGTAAAAAAAGGGG, ATACCACYGGGGGTAAAAAAAGG | 1001 1002 1003 Familial cancer of breast, Breast- ovarian cancer, familial 2, Hereditary cancer predisposing syndrome |
| 119473032 | NM_021020.3(LZTS1): c.35-5A>G (p.Lys119Glu) | CCCTYCTCGGAGCCCTGTAGAGG | 1004 |
| 193922801 | NM_000540.2(RYR1): c.7043A>G (p.Glu2348Gly) | TTCYCCTCCACGCTCTCGCCTGG | 1005 not provided |
| 36210419 | NM_000218.2(KCNQ1): c.652A>G (p.Lys218Glu) | GCCCCTYGGAGCCCACGCAGAGG | 1006 Torsades de pointes, Cardiac arrhythmia |
| 121964989 | NM_000108.4(DLD): c.1483A>G (p.Arg495Gly) | TTCTCYAAAAGCTTCTGATAAGG | 1007 Maple syrup urine disease, type 3 |
| 28936669 | NM_000095.2(COMP): c.1418A>G (p.Asp473Gly) | ATTGYCGTCGTCGTCGTCGCAGG | 1008 |
| 28936696 | NM_018488.2(TBX4): c.1592A>G (p.Gln531Arg) | GTACYGTAAGGAAGATTCTCGGG, GGTACYGTAAGGAAGATTCTCGG | 1009 1010 Ischiopatellar dysplasia |
| 121965077 | NM_000137.2(FAH): c.1141A>G (p.Arg381Gly) | TCCYGGTCTGACCATTCCCCAGG | 1011 Tyrosinemia type I |
| 794728203 | NM_000138.4(FBN1): c.3344A>G (p.Asp1115Gly) | ACTCAYCAATATCTGCAAAATGG | 1012 Thoracic aortic aneurysms and aortic dissections |
| 786205436 | NM_003002.3(SDHD): c.275A>G (p.Asp92Gly) | GAATAGYCCATCGCAGAGCAAGG | 1013 Fatal infantile mitochondrial cardiomyopathy |
| 72551317 | NM_000784.3(CYP27A1): c.776A>G (p.Lys259Arg) | AGTCCACYTGGGGAGGAAGGTGG | 1014 Cholestanol storage disease |
| 786205687 | NM_016218.2(POLK): c.1385A>G (p.Asn462Ser) | ATTCACAYTCTTCAACTTAATGG | 1015 Malignant tumor of prostate |
| 794728280 | NM_000138.4(FBN1): c.7916A>G (p.Tyr2639Cys) | TGTTCAYACTGGAAGCCGGCGGG, CTGTTCAYACTGGAAGCCGGCGG | 1016 1017 Thoracic aortic aneurysms and aortic dissections |
| 28937317 | NM_000335.4(SCN5A): c.3971A>G (p.Asn1324Ser) | GCAYTGACCACCACCTCAAGTGG | 1018 Long QT syndrome 3, Congenital long QT syndrome |
| 786205854 | NM_144499.2(GNAT1): c.386A>G (p.Asp129Gly) | CGGAGYCCTTCCACAGCCGCTGG | 1019 NIGHT BLINDNESS, CONGENITAL STATIONARY, TYPE 1G |
| 104893776 | NM_000539.3(RHO): c.533A>G (p.Tyr178Cys) | GGATGYACCTGAGGACAGGCAGG | 1020 Retinitis pigmentosa 4 |
| 28937590 | NM_001257342.1 (BCS1L):c.232A>G (p.Ser78Gly) | GACACYGAGGTGCTGAGTACGGG, CGACACYGAGGTGCTGAGTACGG | 1021 1022 GRACILE syndrome |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 104893866 | NM_000320.2(QDPR): c.449A>G (p.Tyr150Cys) | TGCCGYACCCGATCATACCTGGG, ATGCCGYACCCGATCATACCTGG | 1023 1024 | Dihydropteridine reductase deficiency |
| 587776590 | NM_015629.3(PRPF31): c.527 + 3A>G | GACAYACCCCTGGGTGGTGGAGG, GCGGACAYACCCCTGGGTGGTGG | 1025 1026 | Retinitis pigmentosa 11 |
| 104894015 | NM_000162.3(GCK): c.641A>G (p.Tyr214Cys) | GTAGYAGCAGGAGATCATCGTGG | 1027 | Hyperinsulinemic hypoglycemia familial 3 |
| 202247823 | NM_000532.4(PCCB): c.1606A>G (p.Asn536Asp) | ATATYTGCATGTTTTCTCCAAGG | 1028 | Propionic acidemia |
| 104894199 | NM_000073.2(CD3G): c.1A>G(p.Met1Val) | CCAYGTCAGTCTCTGTCCTCCGG | 1029 | Immunodeficiency 17 |
| 104894208 | NM_001814.4(CTSC): c.857A>G (p.Gln286Arg) | CTCCYGAGGGCTTAGGATTGGGG, CCTCCYGAGGGCTTAGGATTGGG, ACCTCCYGAGGGCTTAGGATTGG | 1030 1031 1032 | Papillon-Lef\xc3\ xa8vre syndrome, Haim-Munk syndrome |
| 104894211 | NM_001814.4(CTSC): c.1040A>G (p.Tyr347Cys) | TCCTACAYAGTGGTACTCAGAGG | 1033 | Papillon-Lef\xc3\ xa8vre syndrome, Periodontitis, aggressive, 1 |
| 104894290 | NM_000448.2(RAG1): c.2735A>G (p.Tyr912Cys) | CTGYACTGGCAGAGGGATTCTGG | 1034 | Histiocytic medullary reticulosis |
| 104894354 | NM_000217.2(KCNA1): c.676A>G (p.Thr226Ala) | GCGYTTCCACGATGAAGAAGGGG, AGCGYTTCCACGATGAAGAAGGG, CAGCGYTTCCACGATGAAGAAGG | 1035 1036 1037 | Episodic ataxia type 1 |
| 104894425 | NM_014239.3(EIF2B2): c.638A>G (p.Glu213Gly) | AGTTGTCYCAATACCTGCTTTGG | 1038 | Leukoencephalopathy with vanishing white matter, Ovarioleukodystrophy |
| 104894450 | NM_000270.3(PNP): c.383A>G (p.Asp128Gly) | ATAYCTCCAACCTCAAACTTGGG, GATAYCTCCAACCTCAAACTTGG | 1039 1040 | Purine-nucleoside phosphorylase deficiency |
| 147394623 | NM_024887.3(DHDDS): c.124A>G (p.Lys42Glu) | GGCACTYCTTGGCATAGCGACGG | 1041 | Retinitis pigmentosa 59 |
| 60723330 | NM_005557.3(KRT16): c.374A>G (p.Asn125Ser) | GCGGTCAYTGAGGTTCTGCATGG | 1042 | Pachyonychia congenita, type 1, Palmoplantar keratoderma, nonepidermolytic, focal |
| 104894634 | NM_030665.3(RAI1): c.4685A>G (p.Gln1562Arg) | CTGCTGCYGTCGTCGTCGCTTGG | 1043 | Smith-Magenis syndrome |
| 104894730 | NM_000363.4(TNNI3): c.532A>G (p.Lys178Glu) | CCTYCTTCACCTGCTTGAGGTGG, CCTCCTYCTTCACCTGCTTGAGG | 1044 1045 | Familial restrictive cardiomyopathy 1 |
| 104894816 | NM_002049.3(GATA1): c.653A>G (p.Asp218Gly) | GTCCTGYCCCTCCGCCACAGTGG | 1046 | GATA-1-related thrombocytopenia with dyserythropoiesis |
| 794726773 | NM_001165963.1 (SCN1A):c.1662 + 3A>G | GTGCCAYACCTGGTGTGGGGAGG | 1047 | Severe myoclonic epilepsy in infancy |
| 104894861 | NM_000202.6(IDS): c.404A>G (p.Lys135Arg) | AAAGACTYTTCCCACCGACATGG | 1048 | Mucopolysaccharidosis, MPS-II |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 104894874 | NM_000266.3(NDP): c.125A>G(p.His42Arg) | TGGYGCCTCATGCAGCGTCGAGG | 1049 | |
| 191205969 | NM_002420.5(TRPM1): c.296T>C (p.Leu99Pro) | AAGCYCTTAATATCTGTGCATGG | 1050 | Congenital stationary night blindness, type 1C |
| 794727073 | NM_019109.4(ALG1): c.1188-2A>G | TAAACYGCAGAGAGAACCAAGGG, GTAAACYGCAGAGAGAACCAAGG | 1051 1052 | Congenital disorder of glycosylation type 1K |
| 281875236 | NM_001004334.3 (GPR179):c.659A>G (p.Tyr220Cys) | CCCACAYATCCATCTGCCTGCGG | 1053 | Congenital stationary night blindness, type 1E |
| 28939094 | NM_015915.4(ATL1): c.1222A>G (p.Met408Val) | CACCCAYCTTCTTCACCCCTCGG | 1054 | Spastic paraplegia 3 |
| 281875324 | NM_005359.5(SMAD4): c.989A>G (p.Glu330Gly) | ATCCATTYCAAAGTAAGCAATGG | 1055 | Juvenile polyposis syndrome, Hereditary cancer-predisposing syndrome |
| 77173848 | NM_000037.3(ANK1): c.-108T>C | GGGCCYGGCCCGCACGTCACAGG | 1056 | Spherocytosis, type 1, autosomal recessive |
| 150181226 | NM_001159772.1 (CANT1):c.671T>C (p.Leu224Pro) | CGTCYGTACGTGGGCGGCCTGGG, GCGTCYGTACGTGGGCGGCCTGG | 1057 1058 | Desbuquois syndrome |
| 397514253 | NM_000041.3(APOE): c.237-2A>G | CGCCCYGCGGCCGAGAGGGCGGG, GCGCCCYGCGGCCGAGAGGGCGG | 1059 1060 | Familial type 3 hyperlipoproteinemia |
| 397514348 | NM_000060.3(BTD): c.278A>G(p.Tyr93Cys) | GTTCAYAGATGTCAAGGTTCTGG | 1061 | Biotinidase deficiency |
| 397514415 | NM_000060.3(BTD): c.1313A>G (p.Tyr438Cys) | GGCAYACAGCTCTTTGGATAAGG | 1062 | Biotinidase deficiency |
| 397514501 | NM_007171.3(POMT1): c.430A>G (p.Asn144Asp) | GAGCATYCTCTGTTTCAAAGAGG | 1063 | Limb-girdle muscular dystrophy dystroglycanopathy, type C1 |
| 370382601 | NM_174917.4(ACSF3): c.1A>G(p.Met1Val) | GGCAGCAYTGCACTGACAGGCGG | 1064 | not provided |
| 72554332 | NM_000531.5(OTC): c.238A>G (p.Lys80Glu) | AAGGACTYCCCTTGCAATAAAGG | 1065 | Ornithine carbamoyltransferase deficiency |
| 397514599 | NM_033109.4(PNPT1): c.1424A>G (p.Glu475Gly) | GACTYCAGATGTAACTCTTATGG | 1066 | Deafness, autosomal recessive 70 |
| 397514650 | NM_000108.4(DLD): c.1444A>G (p.Arg482Gly) | GACTCYAGCTATATCTTCACAGG | 1067 | Maple syrup urine disease, type 3 |
| 397514675 | NM_003156.3(STIM1): c.251A>G (p.Asp84Gly) | TTCCACAYCCACATCACCATTGG | 1068 | Myopathy with tubular aggregates |
| 794728378 | NM_000238.3(KCNH2): c.1913A>G (p.Lys638Arg) | ATCYTCTCTGAGTTGGTGTTGGG, GATCYTCTCTGAGTTGGTGTTGG | 1069 1070 | Cardiac arrhythmia |
| 397514711 | NM_002163.2(IRF8): c.238A>G (p.Thr80Ala) | AACCTCGYCTTCCAAGTGGCTGG | 1071 | Autosomal dominant CD11C+/CD1C+ dendritic cell deficiency |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 397514729 NM_000388.3(CASR): c.85A>G(p.Lys29Glu) | CCCCCTYCTTTTGGGCTCGCTGG | 1072 | Hypocalcemia, autosomal dominant 1, with baiter syndrome |
| 397514743 NM_022114.3(PRDM16): c.2447A>G (p.Asn816Ser) | GCCGCCGYTTTGGCTGGCACGGG | 1073 | Left ventricular noncompaction 8 |
| 397514757 NM_005689.2(ABCB6): c.508A>G (p.Ser170Gly) | TGGGCYGTTCCAAGACACCAGGG, GTGGGCYGTTCCAAGACACCAGG | 1074 1075 | Dyschromatosis universalis hereditaria 3 |
| 28940313 NM_152443.2(RDH12): c.677A>G (p.Tyr226Cys) | CACTGCGYAGGTGGTGACCCCGG | 1076 | Leber congenital amaurosis 13 |
| 794728538 NM_000218.2(KCNQ1): c.1787A>G (p.Glu596Gly) | GTCTYCTACTCGGTTCAGGCGGG, TGTCTYCTACTCGGTTCAGGCGG | 1077 1078 | Cardiac arrhythmia |
| 794728569 NM_000218.2(KCNQ1): c.605A>G (p.Asp202Gly) | AGGYCTGTGGAGTGCAGGAGAGG | 1079 | Cardiac arrhythmia |
| 794728573 NM_000218.2(KCNQ1): c.1515-2A>G | GCCYGCAGTGGAGAGAGGAGAGG | 1080 | Cardiac arrhythmia |
| 370874727 NM_003494.3(DYSF): c.3349-2A>G | CCGCCCYGGAGACACGAAGCTGG | 1081 | Limb-girdle muscular dystrophy, type 2B |
| 794728859 NM_198056.2(SCN5A): c.2788-2A>G | ACCYGTCGAGATAATGGGTCAGG | 1082 | not provided |
| 794728887 NM_198056.2(SCN5A): c.4462A>G (p.Thr1488Ala) | CCTCTGYCATGAAGATGTCCTGG | 1083 | not provided |
| 28940878 NM_000372.4(TYR): c.125A>G(p.Asp42Gly) | CTCCTGYCCCCGCTCCACGGTGG | 1084 | Tyrosinase-negative oculocutaneous albinism |
| 397515420 NM_172107.2(KCNQ2): c.1636A>G (p.Met546Val) | GCAYGACACTGCAGGGGGGTGGG, CGCAYGACACTGCAGGGGGGTGG, AACCGCAYGACACTGCAGGGGGG | 1085 1086 1087 | Early infantile epileptic encephalopathy 7 |
| 397515428 NM_001410.2(MEGF8): c.7099A>G (p.Ser2367Gly) | GACYCCCGTGAAATGATTCCCGG | 1088 | Carpenter syndrome 2 |
| 143601447 NM_201631.3(TGM5): c.122T>C (p.Leu41Pro) | TCAACCYCACCCTGTACTTCAGG | 1089 | Peeling skin syndrome, acral type |
| 397515519 NM_000207.2(INS): c.*59A>G | GGGCYTTATTCCATCTCTCTCGG | 1090 | Permanent neonatal diabetes mellitus |
| 397515523 NM_000370.3(TTPA): c.191A>G (p.Asp64Gly) | CAGGYCCAGATCGAAATCCCGGG, CCAGGYCCAGATCGAAATCCCGG | 1091 1092 | Ataxia with vitamin E deficiency |
| 397515891 NM_000256.3(MYBPC3): c.1224-2A>G | TACTTGCYGTAGAACAGAAGGGG | 1093 | Familial hypertrophic cardiomyopathy 4, Cardiomyopathy |
| 397516082 NM_000256.3(MYBPC3): c.927-2A>G | GTCCCYGTGTCCCGCAGTCTAGG | 1094 | Familial hypertrophic cardiomyopathy 4, Cardiomyopathy |
| 397516138 NM_000257.3(MYH7): c.2206A>G (p.Ile736Val) | TATCAAYGAACTGTCCCTCAGGG, CTATCAAYGAACTGTCCCTCAGG | 1095 1096 | Familial hypertrophic cardiomyopathy 1, Cardiomyopathy, not specified |
| 1154510 NM002150.2(HPD): c.97-G>A (p.Ala33Thr) | ATGACGYGGCCTGAATCACAGGG, AATGACGYGGCCTGAATCACAGG | 1097 1098 | 4-Alpha-hydroxyphenylpyruvate hydroxylase deficiency |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 397516330 | NM000260.3(MYO7A):<br>c.6439-2A>G | ATATCCYGGGGGAGCAGAAAGGG,<br>GATATCCYGGGGGAGCAGAAAGG | 1099<br>1100 | Usher syndrome, type 1 |
| 72556271 | NM_000531.5(OTC):<br>c.482A>G<br>(p.Asn161Ser) | CAGCCCAYTGATAATTGGGATGG | 1101 | not provided |
| 606231260 | NM_023073.3(C5orf42):<br>c.3290-2A>G | ATCYATCAAATACAAAAATTTGG | 1102 | Orofaciodigital<br>syndrome 6 |
| 587777521 | NM_004817.3(TJP2):<br>c.1992-2A>G | CAGCTCYGAGAAGAAACCACGGG,<br>TCAGCTCYGAGAAGAAACCACGG | 1103<br>1104 | Progressive familial<br>intrahepatic<br>cholestasis 4 |
| 730880846 | NM000257.3(MYH7):<br>c.61-7A>G<br>(p.Lys206Arg) | CTTCYTGCTGCGGTCCCCAATGG | 1105 | Cardiomyopathy |
| 397517978 | NM_206933.2(USH2A):<br>c.12067-2A>G | TTCCCYGTAAGAAAATTAACAGG | 1106 | Usher syndrome, type<br>2A, Retinitis<br>pigmentosa 39 |
| 606231409 | NM_000216.2(ANOS1):<br>c.1A>G(p.Met1Val) | GCACCAYGGCTGCGGGTCGAGGG,<br>GGCACCAYGGCTGCGGGTCGAGG | 1107<br>1108 | Kallmann syndrome 1 |
| 80356546 | NM003334.3(UBA1):<br>c.16-39A>G<br>(p.Ser547Gly) | TGGCYTGTCACCCGGATATGTGG | 1109 | Arthrogryposis<br>multiplex congenita,<br>distal, Xlinked |
| 80356584 | NM_194248.2(OTOF):<br>c.766-2A>G | GACCYGCAGGCAGGAGAAGGGGG,<br>TGACCYGCAGGCAGGAGAAGGGG,<br>CTGACCYGCAGGCAGGAGAAGGG,<br>GCTGACCYGCAGGCAGGAGAAGG | 1110<br>1111<br>1112<br>1113 | Deafness, autosomal<br>recessive 9 |
| 730880930 | NM_000257.3(MYH7):<br>c.1615A>G<br>(p.Met539Val) | GGAACAYGCACTCCTCTTCCAGG | 1114 | Cardiomyopathy |
| 118203947 | NM_013319.2(UBIAD1):<br>c.355A>G<br>(p.Arg119Gly) | TCCYGTCATCACTCTTTTTGTGG | 1115 | Schnyder crystalline<br>corneal dystrophy |
| 60171927 | NM_000526.4(KRT14):<br>c.368A>G<br>(p.Asn123Ser) | GCGGTCAYTGAGGTTCTGCATGG | 1116 | Epidermolysis bullosa<br>herpetiformis,<br>Dowling-Meara |
| 199422248 | NM_001363.4(DKC1):<br>c.941A>G<br>(p.Lys314Arg) | AATCYTGGCCCCATAGCAGATGG | 1117 | Dyskeratosis<br>congenita X-linked |
| 72558467 | NM_000531.5(OTC):<br>c.929A>G<br>(p.Glu310Gly) | TCCACTYCTTCTGGCTTTCTGGG,<br>ATCCACTYCTTCTGGCTTTCTGG | 1118<br>1119 | not provided |
| 72558478 | NM_000531.5(OTC):<br>c.988A>G<br>(p.Arg330Gly) | ACTTTCYGTTTTCTGCCTCTGGG,<br>CACTTTCYGTTTTCTGCCTCTGG | 1120<br>1121 | not provided |
| 118204455 | NM_000505.3(F12):<br>c.158A>G(p.Tyr53Cys) | GGTGGYACTGGAAGGGGAAGTGG | 1122 | |
| 80357477 | NM_007294.3(BRCA1):<br>c.5453A>G<br>(p.Asp1818Gly) | TTGYCCTCTGTCCAGGCATCTGG | 1123 | Familial cancer of<br>breast, Breast-<br>ovarian cancer,<br>familial 1 |
| 121907908 | NM_024426.4(VVT1):<br>c.1021A>G<br>(p.Ser341Gly) | CGCYCTCGTACCCTGTGCTGTGG | 1124 | Mesothelioma |
| 121907926 | NM_000280.4(PAX6):<br>c.1171A>G<br>(p.Thr391Ala) | GTGGYGCCCGAGGTGCCCATTGG | 1125 | Optic nerve aplasia,<br>bilateral |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121908023 | NM_024740.2(ALG9):<br>c.860A>G<br>(p.Tyr287Cys) | TTAYACAAAACAATGTTGAGTGG | 1126 Congenital disorder of<br>glycosylation type 1L |
| 121908148 | NM_001243133.1<br>(NLRP3):c.1880A>G<br>(p.Glu627Gly) | ACAATYCCAGCTGGCTGGGCTGG | 1127 Familial cold<br>urticaria |
| 121908166 | NM_006492.2(ALX3):<br>c.608A>G<br>(p.Asn203Ser) | CGGYTCTGGAACCAGACCTGGGG,<br>GCGGYTCTGGAACCAGACCTGGG,<br>TGCGGYTCTGGAACCAGACCTGG | 1128 Frontonasal<br>1129 dysplasia 1<br>1130 |
| 121908184 | NM_020451.2(SEPN1):<br>c.1A>G(p.Met1Val) | CCCAYGGCTGCGGCTGGCGGCGG,<br>CGGCCCAYGGCTGCGGCTGGCGG | 1131 Eichsfeld type<br>1132 congenital muscular<br>dystrophy |
| 121908258 | NM_130468.3(CHST14):<br>c.878A>G<br>(p.Tyr293Cys) | AAGTCAYAGTGCACGGCACAAGG | 1133 Ehlers-Danlos<br>syndrome,<br>musculocontractural<br>type |
| 121908383 | NM_001128425.1<br>(MUTYH):c.1241A>G<br>(p.Gln414Arg) | AAGCYGCTCTGAGGGCTCCCAGG | 1134 Neoplasm of stomach |
| 121908580 | NM_004328.4(BCS1L):<br>c.148A>G<br>(p.Thr50Ala) | GTGYGATCATGTAATGGCGCCGG | 1135 Mitochondrial complex<br>III deficiency |
| 121908584 | NM_016417.2(GLRX5):<br>c.294A>G<br>(p.Gln98.) | CCTGACCYTGTCGGAGCTCCGGG | 1136 Anemia, sideroblastic,<br>pyridoxine-refractory,<br>autosomal recessive |
| 121908635 | NM_022817.2(PER2):<br>c.1984A>G<br>(p.Ser662Gly) | GCCACACYCTCTGCCTTGCCCGG | 1137 Advanced sleep phase<br>syndrome, familial |
| 121908655 | NM_003839.3<br>(TNFRSF11A):c.508A>G<br>(p.Arg170Gly) | GGGTCYGCATTTGTCCGTGGAGG | 1138 Osteopetrosis<br>autosomal recessive 7 |
| 29001653 | NM_000539.3(RHO):<br>c.886A>G<br>(p.Lys296Glu) | CGCTCTYGGCAAAGAACGCTGGG,<br>GCGCTCTYGGCAAAGAACGCTGG | 1139 Retinitis pigmentosa 4<br>1140 |
| 56307355 | NM_006502.2(POLH):<br>c.1603A>G<br>(p.Lys535Glu) | AGACTTTYCTGCTTAAAGAAGGG | 1141 Xeroderma<br>pigmentosum, variant<br>type |
| 121908919 | NM_002977.3(SCN9A):<br>c.1964A>G<br>(p.Lys655Arg) | CCTTTTCYTGTGTATTTGATTGG | 1142 Generalized epilepsy<br>with febrile seizures<br>plus, type 7, not<br>specified |
| 121908939 | NM_006892.3(DNMT3B):<br>c.2450A>G<br>(p.Asp817Gly) | GACACGYCTGTGTAGTGCACAGG | 1143 Centromeric<br>instability of<br>chromosomes 1,9 and<br>16 and<br>immunodeficiency |
| 121909088 | NM_001005360.2(DNM2):<br>c.1684A>G<br>(p.Lys562Glu) | ACTYCTTCTCTTTCTCCTGAGGG,<br>TACTYCTTCTCTTTCTCCTGAGG | 1144 Charcot-Marie-Tooth<br>1145 disease, dominant<br>intermediate b, with<br>neutropenia |
| 120074112 | NM_000483.4(APOC2):<br>c.1A>G(p.Met1Val) | GCCCAYAGTGTCCAGAGACCTGG | 1146 Apolipoprotein C2<br>deficiency |
| 121909239 | NM_000314.6(PTEN):<br>c.755A>G<br>(p.Asp252Gly) | ATAYCACCACACACAGGTAACGG | 1147 Macrocephaly/autism<br>syndrome |
| 121909251 | NM_198217.2(ING1):<br>c.515A>G<br>(p.Asn172Ser) | TGGYTGCACAGACAGTACGTGGG,<br>CTGGYTGCACAGACAGTACGTGG | 1148 Squamous cell<br>1149 carcinoma of the head<br>and neck |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 121909396 | NM_001174089.1 (SLC4A11):c.2518A>G (p.Met840Val) | GATCAYCTTCATGTAGGGCAGGG, AGATCAYCTTCATGTAGGGCAGG | 1150 1151 | Corneal dystrophy and perceptive deafness |
| 121909533 | NM_000034.3(ALDOA): c.386A>G (p.Asp129Gly) | CCAYCCAACCCTAAGAGAAGAGG | 1152 | HNSHA due to aldolase A deficiency |
| 128627255 | NM_004006.2(DMD): c.835A>G (p.Thr279Ala) | TGACCGYGATCTGCAGAGAAGGG, CTGACCGYGATCTGCAGAGAAGG | 1153 1154 | Dilated cardiomyopathy 3B |
| 116929575 | NM_001085.4 (SERPINA3):c.1240A>G (p.Met414Val) | GCTCAYGAAGAAGATGTTCTGGG, TGCTCAYGAAGAAGATGTTCTGG | 1155 1156 | |
| 61748392 | NM_004992.3(MECP2): c.410A>G (p.Glu137Gly) | CAACYCCACTTTAGAGCGAAAGG | 1157 | Mental retardation, X-linked, syndromic 13 |
| 61748906 | NM_001005741.2(GBA): c.667T>C (p.Trp223Arg) | CCCACTYGGCTCAAGACCAATGG | 1158 | Gaucher disease, type 1 |
| 199473024 | NM_000238.3(KCNH2): c.3118A>G (p.Ser1040Gly) | CTGCYCTCCACGTCGCCCGGGG, CCTGCYCTCCACGTCGCCCCGGG, GCCTGCYCTCCACGTCGCCCCGG | 1159 1160 1161 | Sudden infant death syndrome |
| 794728365 | NM_000238.3(KCNH2): c.1129-2A>G | GGACCYGCACCCGGGGAAGGCGG | 1162 | Cardiac arrhythmia |
| 72556293 | NM_000531.5(OTC): c.548A>G (p.Tyr183Cys) | AGAGCTAYAGTGTTCCTAAAAGG | 1163 | not provided |
| 111033244 | NM_000441.1(SLC26A4): c.1151A>G (p.Glu384Gly) | TGAATYCCTAAGGAAGAGACTGG | 1164 | Pendred syndrome, Enlarged vestibular aqueduct syndrome |
| 111033415 | NM_000260.3(MYO7A): c.1344-2A>G | AGCYGCAGGGGCACAGGGATGGG, AAGCYGCAGGGGCACAGGGATGG | 1165 1166 | Usher syndrome, type 1 |
| 121912439 | NM_000454.4(SOD1): c.302A>G (p.Glu101Gly) | AGAATCTYCAATAGACACATCGG | 1167 | Amyotrophic lateral sclerosis type 1 |
| 111033567 | NM_002769.4(PRSS1): c.68A>G (p.Lys23Arg) | ATCYTGTCATCATCATCAAAGGG, GATCYTGTCATCATCATCAAAGG | 1168 1169 | Hereditary pancreatitis |
| 121912565 | NM_000901.4(NR3C2): c.2327A>G (p.Gln776Arg) | TCATCYGTTTGCCTGCTAAGCGG | 1170 | Pseudohypoaldo-steronism type 1 autosomal dominant |
| 121912574 | NM_000901.4(NR3C2): c.2915A>G (p.Glu972Gly) | CCGACYCCACCTTGGGCAGCTGG | 1171 | Pseudohypoaldo-steronism type 1 autosomal dominant |
| 121912589 | NM_001173464.1 (KIF21A):c.2839A>G (p.Met947Val) | ATTCAYATCTGCCTCCATGTTGG | 1172 | Fibrosis of extraocular muscles, congenital, 1 |
| 111033661 | NM_000155.3(GALT): c.253-2A>G | ATTCACCYACCGACAAGGATAGG | 1173 | Deficiency of UDPglucose-hexose-1-phosphate uridylyltransferase |
| 111033669 | NM_000155.3(GALT): c.290A>G (p.Asn97Ser) | GAAGTCGYTGTCAAACAGGAAGG | 1174 | Deficiency of UDPglucose-hexose-1-phosphate uridylyltransferase |
| 111033682 | NM_000155.3(GALT): c.379A>G (p.Lys127Glu) | TGACCYACTGGGTGGTGACGGG, ATGACCYACTGGGTGGTGACGG | 1175 1176 | Deficiency of UDPglucose-hexose-1-phosphate uridylyltransferase |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 111033786 | NM_000155.3(GALT): c.950A>G (p.Gln317Arg) | CAGCYGCCAATGGTTCCAGTTGG | 1177 | Deficiency of UDPglucose-hexose-1-phosphate uridylyltransferase |
| 121912765 | NM_001202.3(BMP4): c.278A>G (p.Glu93Gly) | CCTCCYCCCAGACTGAAGCCGG | 1178 | Microphthalmia syndromic 6 |
| 121912856 | NM_000094.3(COL7A1): c.425A>G (p.Lys142Arg) | CACCYTGGGGACACCAGGTCGGG, TCACCYTGGGGACACCAGGTCGG | 1179 1180 | Epidermolysis bullosa dystrophica inversa, autosomal recessive |
| 199474715 | NM_152263.3(TPM3): c.505A>G (p.Lys169Glu) | CCAACTYACGAGCCACCTACAGG | 1181 | Congenital myopathy with fiber type disproportion |
| 199474718 | NM_152263.3(TPM3): c.733A>G (p.Arg245Gly) | ATCYCTCAGCAAACTCAGCACGG | 1182 | Congenital myopathy with fiber type disproportion |
| 121912895 | NM_001844.4(COL2A1): c.2974A>G (p.Arg992Gly) | CCTCYCTCACCACGTTGCCCAGG | 1183 | Spondyloepimetaphyseal dysplasia Strudwick type |
| 121913074 | NM_000129.3(F13A1): c.851A>G (p.Tyr284Cys) | ATAGGCAYAGATATTGTCCCAGG | 1184 | Factor xiii, a subunit, deficiency of |
| 121913145 | NM_000208.2(INSR): c.707A>G (p.His236Arg) | GCTGYGGCAACAGAGGCCTTCGG | 1185 | Leprechaunism syndrome |
| 312262745 | NM_025137.3(SPG11): c.2608A>G (p.Ile870Val) | ACTTAYCCTGGGGAGAAGGATGG | 1186 | Spastic paraplegia 11, autosomal recessive |
| 121913682 | NM_000222.2(KIT): c.2459A>G (p.Asp820Gly) | AGAAYCATTCTTGATGTCTCTGG | 1187 | Mast cell disease, systemic |
| 587776757 | NM_000151.3(G6PC): c.230 + 4A>G | GTTCYTACCACTTAAAGACGAGG | 1188 | Glycogen storage disease type 1A |
| 61752063 | NM_000330.3(RS1): c.286T>C(p.Trp96Arg) | TTCTTCGYGGACTGCAAACAAGG | 1189 | Juvenile retinoschisis |
| 367543065 | NM_024549.5(TCTN1): c.221-2A>G | AGCAACYGCAGAAAAAGAGGGG, CAGCAACYGCAGAAAAAGAGGG | 1190 1191 | Joubert syndrome 13 |
| 5030773 | NM_000894.2(LHB): c.221A>G(p.Gln74Arg) | CCACCYGAGGCAGGGGCGGCAGG | 1192 | Isolated lutropin deficiency |
| 199476092 | NM_000264.3(PTCH1): c.2479A>G (p.Ser827Gly) | CGTTACYGAAACTCCTGTGTAGG | 1193 | Gorlin syndrome, Holoprosencephaly 7, not specified |
| 398123158 | NM_000117.2(EMD): c.450-2A>G | CGTTCCCYGAGGCAAAAGAGGGG | 1194 | not provided |
| 199476103 | RMRP:n.71A>G | ACTTYCCCTAGGCGGAAAGGGG, GACTTYCCCTAGGCGGAAAGGG, GGACTTYCCCTAGGCGGAAAGG | 1195 1196 1197 | Metaphyseal chondrodysplasia, McKusick type, Metaphyseal dysplasia without hypotrichosis |
| 5030856 | NM_000277.1(PAH): c.1169A>G (p.Glu390Gly) | CTCYCTGCCACGTAATACAGGGG, ACTCYCTGCCACGTAATACAGGG, AACTCYCTGCCACGTAATACAGG | 1198 1199 1200 | Phenylketonuria, Hyperphenylalaninemia, nonpku |
| 5030860 | NM_000277.1(PAH): c.1241A>G (p.Tyr414Cys) | GGGTCGYAGCGAACTGAGAAGGG, TGGGTCGYAGCGAACTGAGAAGG | 1201 1202 | Phenylketonuria, Hyperphenylalaninemia, nonpku |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 587777055 | NM_020988.2(GNAO1): c.521A>G (p.Asp174Gly) | GGATGYCCTGCTCGGTGGGCTGG | 1203 | Early infantile epileptic encephalopathy 17 |
| 587777223 | NM_024301.4(FKRP): c.1A>G(p.Met1Val) | CCGCAYGGGGCCGAAGTCTGGGG, GCCGCAYGGGGCCGAAGTCTGGG, AGCCGCAYGGGGCCGAAGTCTGG | 1204 1205 1206 | Congenital muscular dystrophy dystrogly- canopathy with brain and eye anomalies type A5 |
| 587777479 | NM_003108.3(SOX11): c.347A>G (p.Tyr116Cys) | GTACTTGYAGTCGGGGTAGTCGG | 1207 | Mental retardation, autosomal dominant 27 |
| 587777496 | NM_020435.3(GJC2): c.-170A>G | TTGYTCCCCCCTCGGCCTCAGGG, ATTGYTCCCCCCTCGGCCTCAGG | 1208 1209 | Leukodystrophy, hypomyelinating, 2 |
| 587777507 | NM_022552.4(DNMT3A): c.1943T>C (p.Leu648Pro) | CTCCYGGTGCTGAAGGACTTGGG, GCTCCYGGTGCTGAAGGACTTGG | 1210 1211 | Tatton-Brown-rahman syndrome |
| 587777557 | NM_018400.3(SCN3B): c.482T>C (p.Met161Thr) | AATCAYGATGTACATCCTTCTGG | 1212 | Atrial fibrillation, familial, 16 |
| 587777569 | NM_001030001.2 (RPS29):c.149T>C (p.Ile50Thr) | GATAYCGGTTTCATTAAGGTAGG | 1213 | Diamond-Blackfan anemia 13 |
| 587777657 | NM_153334.6(SCARF2): c.190T>C (p.Cys64Arg) | CCACGYGCTGCGCTGGCTGGAGG | 1214 | Marden Walker like syndrome |
| 587777689 | NM_005726.5(TSFM): c.57 + 4A>G | ACTTCYCACCGGGTAGCTCCCGG | 1215 | Combined oxidative phosphorylation deficiency 3 |
| 796052005 | NM_000255.3(MUT): c.329A>G (p.Tyr110Cys) | GCAYACTGGCGGATGGTCCAGGG, AGCAYACTGGCGGATGGTCCAGG | 1216 1217 | not provided |
| 587777809 | NM_144596.3(TTC8): c.115-2A>G | GTTCCYGGAAAGCATTAAGAAGG | 1218 | Retinitis pigmentosa 51 |
| 587777878 | NM_000166.5(GJB1): c.580A>G (p.Met194Val) | TAGCAYGAAGACGGTGAAGACGG | 1219 | X-linked hereditary motor and sensory neuropathy |
| 74315420 | NM_001029871.3 (RSPO4):c.194A>G (p.GIn65Arg) | CGTACYGGCGGATGCCTTCCCGG | 1220 | Anonychia |
| 180177219 | NM_000030.2(AGXT): c.424-2A>G (p.Gly_142Gln145del) | AGGCCCYGAGGAAGCAGGGACGG | 1221 | Primary hyperoxaluria, type I |
| 367610201 | NM_002693.2(POLG): c.1808T>C (p.Met603Thr) | CTCAYGGCACTTACCTGGGATGG | 1222 | not provided |
| 180177319 | NM_012203.1(GRHPR): c.84-2A>G | TCACAGCYGCGGGGAAAGGGAGG | 1223 | Primary hyperoxaluria, type II |
| 796052068 | NM_000030.2(AGXT): c.777-2A>G | GGTACCYGGAAGACACGAGGGGG, TGGTACCYGGAAGACACGAGGGG | 1224 1225 | Primary hyperoxaluria, type I |
| 61754010 | NM_000552.3(VWF): c.1583A>G (p.Asn528Ser) | TGCCAYTGTAATTCCCACACAGG | 1226 | von Willebrand disease, type 2a |
| 587778866 | NM_000321.2(RB1): c.1927A>G (p.Lys643Glu) | ATTYCAATGGCTTCTGGGTCTGG | 1227 | Retinoblastoma |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 74435397 | NM_006331.7(EMG1): c.257A>G (p.Asp86Gly) | ATAYCTGGCCGCGCTTCCCCAGG | 1228 | Bowen-Conradi syndrome |
| 796052527 | NM_000156.5(GAMT): c.1A>G(p.Met1Val) | CGCTCAYGCTGCAGGCTGGACGG | 1229 | not provided |
| 796052637 | NM_172107.2(KCNQ2): c.848A>G (p.Lys283Arg) | GTACYTGTCCCCGTAGCCAATGG | 1230 | not provided |
| 724159963 | NM_032228.5(FAR1): c.1094A>G (p.Asp365Gly) | GATAYCATACAGGAATGCTGGGG, AGATAYCATACAGGAATGCTGGG, TAGATAYCATACAGGAATGCTGG | 1231 1232 1233 | Peroxisomal fatty acylcoa reductase 1 disorder |
| 587779722 | NM_000090.3(COL3A1): c.1762-2A>G (p.Gly588_GIn605del) | CACCCYAAAGAAGAAGTGGTCGG | 1234 | Ehlers-Danlos syndrome, type 4 |
| 118192102 | m.8296A>G | TTTACAGYGGGCTCTAGAGGGGG | 1235 | Diabetes-deafness syndrome maternally transmitted |
| 727502787 | NM_001077494.3 (NFKB2):c.2594A>G (p.Asp865Gly) | CTGYCTTCCTTCACCTCTGCTGG | 1236 | Common variable immunodeficiency 10 |
| 727503036 | NM_000117.2(EMD): c.266-2A>G | AGCCYTGGGAAGGGGGGCAGCGG | 1237 | Emery-Dreifuss muscular dystrophy 1, X-linked |
| 690016544 | NM_005861.3(STUB1): c.194A>G (p.Asn65Ser) | GGCCCGGYTGGTGTAATACACGG | 1238 | Spinocerebellar ataxia, autosomal recessive 16 |
| 690016554 | NM_005211.3(CSF1R): c.2655-2A>G | GTATCYGGGAGATAGGACAGAGG | 1239 | Hereditary diffuse leukoencephalopathy with spheroids |
| 118192185 | NM_172107.2(KCNQ2): c.1A>G(p.Met1Val) | GCACCAYGGTGCCTGGCGGGAGG | 1240 | Benign familial neonatal seizures 1 |
| 121917869 | NM_012064.3(MIP): c.401A>G (p.Glu134Gly) | AGATCYCCACTGTGGTTGCCTGG | 1241 | Cataract 15, multiple types |
| 121918014 | NM_000478.4(ALPL): c.1250A>G (p.Asn417Ser) | AGGCCCAYTGCCATACAGGATGG | 1242 | Infantile hypophosphatasia |
| 121918036 | NM_000174.4(GP9): c.110A>G(p.Asp37Gly) | GCAGYCCACCCACAGCCCCATGG | 1243 | Bernard-Soulier syndrome type C |
| 121918089 | NM_000371.3(TTR): c.379A>G (p.Ile127Val) | CGGCAAYGGTGTAGCGGCGGGGG, GCGGCAAYGGTGTAGCGGCGGGG | 1244 1245 | Amyloidogenic transthyretin amyloidosis |
| 121918121 | NM_000823.3(GHRHR): c.985A>G (p.Lys329Glu) | CGACTYGGAGAGACGCCTGCAGG | 1246 | Isolated growth hormone deficiency type 1B |
| 121918333 | NM_015335.4(MED13L): c.6068A>G (p.Asp2023Gly) | ATATCAYCTAGAGGGAAGGGGGG, CATATCAYCTAGAGGGAAGGGGG | 1247 1248 | Transposition of great arteries |
| 121918605 | NM_001035.2(RYR2): c.12602A>G (p.GIn4201Arg) | CGCCAGCYGCATTTCAAAGATGG | 1249 | Catecholaminergic polymorphic ventricular tachycardia |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 587781262 | NM_002764.3(PRPS1): c.343A>G (p.Met115Val) | TAGCAYATTTGCAACAAGCTTGG | 1250 | Charcot-Marie-Tooth disease, X-linked recessive, type 5, Deafness, high-frequency sensorineural, X-linked |
| 121918608 | NM_001161766.1 (AHCY):c.344A>G (p.Tyr115Cys) | GCGGGYACTTGGTGTGGATGAGG | 1251 | Hypermethioninemia with sadenosylhomocysteine hydrolase deficiency |
| 121918613 | NM_000702.3(ATP1A2): c.1033A>G (p.Thr345Ala) | CTGYCAGGGTCAGGCACACCTGG | 1252 | Familial hemiplegic migraine type 2 |
| 587781339 | NM_000535.5(PMS2): c.904-2A>G | GCAGACCYGCACAAAATACAAGG | 1253 | Hereditary cancer-predisposing syndrome |
| 121918691 | NM_001128177.1 (THRB):c.1324A>G (p.Met442Val) | CTTCAYGTGCAGGAAGCGGCTGG | 1254 | Thyroid hormone resistance, generalized, autosomal dominant |
| 121918692 | NM_001128177.1 (THRB):c.1327A>G (p.Lys443Glu) | CCACCTYCATGTGCAGGAAGCGG | 1255 | Thyroid hormone resistance, generalized, autosomal dominant |
| 727504333 | NM_000256.3(MYBPC3): c.2906-2A>G | CCGTTCYGTGGGTATAGAGTGGG, GCCGTTCYGTGGGTATAGAGTGG | 1256 1257 | Familial hypertrophic cardiomyopathy 4 |
| 786200910 | NM_006204.3(PDE6C): c.1483-2A>G | CTTTCYGTTGAAATAAGGATGGG, TCTTTCYGTTGAAATAAGGATGG | 1258 1259 | Achromatopsia 5 |
| 281860296 | NM_000551.3(VHL): c.586A>T (p.Lys196Ter) | GGTCTTYCTGCACATTTGGGTGG | 1260 | Von Hippel-Lindau syndrome |
| 730880444 | NM_000169.2(GLA): c.370-2A>G | GTGAACCYGAAATGAGAGGGAGG | 1261 | not provided |
| 730880531 | NM_000256.3(MYBPC3): c.1227-2A>G | GTACCYGGGTGGGGGCCGCAGGG, TGTACCYGGGTGGGGGCCGCAGG | 1262 1263 | Familial hypertrophic cardiomyopathy 4, Cardiomyopathy |
| 267606643 | NM_013411.4(AK2): c.494A>G (p.Asp165Gly) | TCAYCTTTCATGGGCTCTTTTGG | 1264 | Reticular dysgenesis |
| 267606705 | NM_005188.3(CBL): c.1144A>G (p.Lys382Glu) | TATTTYACATAGTTGGAATGTGG | 1265 | Noonan syndrome-like disorder with or without juvenile myelomonocytic leukemia |
| 62642934 | NM_000277.1(PAH): c.916A>G (p.Ile306Val) | GGCCAAYTTCCTGTAATTGGGGG, AGGCCAAYTTCCTGTAATTGGGG | 1266 1267 | Phenylketonuria, Hyperphenylalaninemia, nonpku |
| 267606782 | NM_000117.2(EMD): c.1A>G(p.Met1Val) | TCCAYGGCGGGTGCGGGCTCAGG | 1268 | Emery-Dreifuss muscular dystrophy, X-linked |
| 267606820 | NM_014053.3(FLVCR1): c.361A>G (p.Asn121Asp) | AGGCGTYGACCAGCGAGTACAGG | 1269 | Posterior column ataxia with retinitis pigmentosa |
| 730880805 | NM_000257.3(MYH7): c.4664A>G (p.Glu1555Gly) | GCCCYCCTCGTGCTCCAGGGAGG, CTTGCCCYCCTCGTGCTCCAGGG | 1270 1271 | Cardiomyopathy |
| 267606834 | NM_138387.3(G6PC3): c.346A>G (p.Met116Val) | TGATCAYGCAGTGTCCAGAAGGG, GTGATCAYGCAGTGTCCAGAAGG | 1272 1273 | Dursun syndrome |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 267606851 | NM_000175.3(GP1):<br>c.1028A>G<br>(p.Gln343Arg) | GTACYGGTCATAGGGCAGCATGG | 1274 Hemolytic anemia,<br>nonspherocytic, due<br>to glucose phosphate<br>isomerase deficiency |
| 515726182 | NM_015713.4(RRM2B):<br>c.190T>C<br>(p.Trp64Arg) | TTCCTTCYGGACAGCAGAAGAGG | 1275 RRM2B-related<br>mitochondrial disease |
| 730881002 | NM_002880.3(RAF1):<br>c.1279A>G<br>(p.Ser427Gly) | GCTGCYGCCCTCGCACCACTGGG,<br>GGCTGCYGCCCTCGCACCACTGG | 1276 Rasopathy<br>1277 |
| 267607030 | NM_002977.3(SCN9A):<br>c.29A>G<br>(p.Gln10Arg) | AAGCTCYGAGGTCCTGGGGGAGG | 1278 Primary<br>erythromelalgia |
| 267607048 | NM_007373.3(SHOC2):<br>c.4A>G(p.Ser2Gly) | TACYCATGGTGACTCAAGCCTGG | 1279 Noonan-like syndrome<br>with loose anagen<br>hair, Rasopathy |
| 587783486 | NM_004380.2(CREBBP):<br>c.3983-2A>G | GCAGCCCYAGGAAGTCCAGAAGG | 1280 Rubinstein-Taybi<br>syndrome |
| 730881357 | NM_000051.3(ATM):<br>c.3154-2A>G | AGCCYACGGGAAAAGAACTGTGG | 1281 Hereditary cancer-<br>predisposing syndrome |
| 398122404 | NM_001256864.1<br>(DNAJC6):c.801-2A>G | AGGTATCYGAAACAGAAGGTTGG | 1282 Parkinson disease 19,<br>juvenile-onset |
| 267607482 | NM_001927.3(DES):<br>c.1024A>G<br>(p.Asn342Asp) | GAATCGTYCTGCAGGAGAGGGGG | 1283 Myofibrillar<br>myopathy 1 |
| 796053439 | NM_000391.3(TPP1):<br>c.833A>G<br>(p.GIn278Arg) | CAGGTACYGCACATCTAGACTGG | 1284 not provided |
| 587783835 | NM_000252.2(MTM1):<br>c.550A>G<br>(p.Arg184Gly) | GTTATTCYCCAATGGTGATTGGG | 1285 Severe X-linked<br>myotubular myopathy |
| 587783842 | NM_000252.2(MTM1):<br>c.629A>G<br>(p.Asp210Gly) | TCATCAYCTGAGGCACGATACGG | 1286 Severe X-linked<br>myotubular myopathy |
| 267607777 | NM_000249.3(MLH1):<br>c.884 + 4A>G | TGCTACAYTACCTGAGGTACAGG | 1287 Hereditary<br>Nonpolyposis<br>Colorectal<br>Neoplasms |
| 33972047 | NM_000518.4(HBB):<br>c.59A>G(p.Asn20Ser) | CACGYTCACCTTGCCCCACAGGG,<br>CCACGYTCACCTTGCCCCACAGG | 1288 alpha Thalassemia<br>1289 |
| 730882004 | NM_000546.5(TP53):<br>c.709A>G<br>(p.Met237Val) | ACACAYGTAGTTGTAGTGGATGG | 1290 Li-Fraumeni syndrome,<br>Hereditary<br>cancerpredisposing<br>syndrome |
| 730882052 | NM_001231.4(CASQ1):<br>c.731A>G<br>(p.Asp244Gly) | GGCTTGYCTGGGATGGTCACAGG | 1291 Myopathy, vacuolar,<br>with casq1 aggregates |
| 80338959 | NM_000334.4(SCN4A):<br>c.4078A>G<br>(p.Met1360Val) | GATCAYGATGGTGATGTCGAAGG | 1292 Hyperkalemic Periodic<br>Paralysis Type 1 |
| 80338960 | NM_000334.4(SCN4A):<br>c.4108A>G<br>(p.Met1370Val) | CCATCAYGGTGACCATGTTGAGG | 1293 Hyperkalemic Periodic<br>Paralysis Type 1 |
| 80338962 | NM_000334.4(SCN4A):<br>c.4774A>G<br>(p.Met1592Val) | TGTACAYGTTGACCACGATGAGG | 1294 Hyperkalemic Periodic<br>Paralysis Type 1,<br>Familial hyperkalemic<br>periodic paralysis |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 398123062 | NM_012160.4(FBXL4): c.1694A>G (p.Asp565Gly) | TATGYCCAGCTGCTGTAACCTGG | 1295 | Mitochondrial DNA depletion syndrome 13 (encephalomyopathic type) |
| 730882140 | NM_001039550.1 (DNAJB2):c.14A>G (p.Tyr5Cys) | GATCTCGYAGTAGGATGCCATGG | 1296 | Charcot-Marie-Tooth disease, Charcot-MarieTooth disease, axonal, type 2T |
| 796053522 | NM_052859.3(RFT1): c.122-2A>G (p.Met408Val) | GCAYCACAAAATTGTACCTGGGG, AGCAYCACAAAATTGTACCTGGG, CAGCAYCACAAAATTGTACCTGG | 1297 1298 1299 | Congenital disorder of glycosylation type 1N |
| 398123211 | NM_000169.2(GLA): c.548-2A>G | AACCYGTATGAGAAAACAATGGG, TAACCYGTATGAGAAAACAATGG | 1300 1301 | Fabry disease |
| 587784423 | NM_006306.3(SMC1A): c.616-2A>G | AGCCYGTGCAAACAGGGGAATGG | 1302 | Congenital muscular hypertrophy-cerebral syndrome |
| 398123411 | NM_000487.5(ARSA): c.1108-2A>G | GGCTCYGGGGGCAGAGTCAGGGG, GGGCTCYGGGGGCAGAGTCAGGG, AGGGCTCYGGGGGCAGAGTCAGG | 1303 1304 1305 | Metachromatic leukodystrophy |
| 398123429 | NM_000512.4(GALNS): c.1171A>G (p.Met391Val) | CCGCCAYCAGCGTGTCGCCACGG | 1306 | Mucopolysaccharidosis, MPS-IV-A |
| 267608500 | NM_003159.2(CDKL5): c.578A>G (p.Asp193Gly) | ATGYCCACGGACTTTCCATAGGG, CATGYCCACGGACTTTCCATAGG | 1307 1308 | Early infantile epileptic encephalopathy 2 |
| 398123552 | NM_000402.4(G6PD): c.188T>C(p.Ile63Thr) | ACACACAYATTCATCATCATGGG | 1309 | Anemia, nonspherocytic hemolytic, due to G6PD deficiency |
| 75391579 | NM_000155.3(GALT): c.563A>G (p.Gln188Arg) | TTACCYGGCAGTGGGGGTGGGGG, CTTACCYGGCAGTGGGGGTGGGG, CCTTACCYGGCAGTGGGGGTGGG | 1310 1311 1312 | Deficiency of UDPglucose-hexose-1-phosphate uridylyltransferase |
| 398123639 | NM_001848.2(COL6A1): c.805-2A>G | TTCTCCCYGGAACACAAAACAGG | 1313 | Ullrich congenital muscular dystrophy, Bethlem myopathy |
| 398123750 | NM_003482.3(KMT2D): c.5645-2A>G | GCAGTTCYGTGGGGGAATGAAGG | 1314 | Kabuki make-up syndrome |
| 398124528 | NM_144997.5(FLCN): c.1433-2A>G | CCCACYGGGGAGAAGGGCAGGGG, GCCCACYGGGGAGAAGGGCAGGG, GGCCCACYGGGGAGAAGGGCAGG | 1315 1316 1317 | Hereditary cancer-predisposing syndrome |
| 113994149 | NM_025265.3(TSEN2): a926A>G (p.Tyr309Cys) | CAGAGCAYAGACCAAGAAAAAGG | 1318 | Pontocerebellar hypoplasia type 2B |
| 281865052 | NM_198578.3(LRRK2): a5605A>G (p.Met1869Val) | TCAACAYAATATTTCTAGGCAGG | 1319 | Parkinson disease 8, autosomal dominant |
| 281865495 | NM_004614.4(TK2): c.562A>G (p.Thr188Ala) | AAGYCTCAGGATTGGTCCGAAGG | 1320 | Mitochondrial DNA depletion syndrome 2 |
| 756328339 | NM_003494.3(DYSF): c.3041A>G (p.Tyr1014Cys) | CTAYACTCCCAGCCTGGGGGAGG, ATGCTAYACTCCCAGCCTGGGGG, GATGCTAYACTCCCAGCCTGGGG | 1321 1322 1323 | Limb-girdle muscular dystrophy, type 2B |
| 387906810 | NM_153427.2(PITX2): c.262A>G (p.Lys88Glu) | TCTYGAACCAAACCTGGGGCGG, GATTCTYGAACCAAACCTGGGGG, CGATTCTYGAACCAAACCTGGGG | 1324 1325 1326 | Axenfeld-Rieger syndrome type 1 |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 78310959 | NM_030964.3(SPRY4):<br>c.530A>G<br>(p.Lys177Arg) | AGTGCYTGTCCAGCTCGGGTGGG,<br>AAGTGCYTGTCCAGCTCGGGTGG | 1327<br>1328 | Hypogonadotropic<br>hypogonadism 17 with<br>or without anosmia |
| 144109267 | NM_207352.3(CYP4V2):<br>c.1393A>G<br>(p.Arg465Gly) | TTCCYGGGGCCAGCAGAGAAGGG,<br>GTTCCYGGGGCCAGCAGAGAAGG | 1329<br>1330 | Bietti crystalline<br>corneoretinal<br>dystrophy |
| 104886319 | NM_000495.4(COL4A5):<br>c.1340-2A>G | CACCYGAGTAAGATAAAGAAAGG | 1331 | Alport syndrome,<br>X-linked recessive |
| 104886416 | NM_000495.4(COL4A5):<br>c.466-2A>G | ACCCYAAAAGAAGCCATCAATGG | 1332 | Alport syndrome,<br>X-linked recessive |
| 121434443 | NM_004984.2(KIF5A):<br>c.827A>G<br>(p.Tyr276Cys) | GAACAYAGCTTTTCTGGGGGAGG | 1333 | Spastic paraplegia 10 |
| 199422314 | NM_001099274.1<br>(TINF2):c.850A>G<br>(p.Thr284Ala) | TGACTGYGGGGCGCTCCTTATGG | 1334 | Dyskeratosis congenita<br>autosomal dominant |
| 121434478 | NM_004044.6(ATIC):<br>c.1277A>G<br>(p.Lys426Arg) | AGTGTACYTGACAGCAATGGTGG | 1335 | AICAR<br>transformylase/IMP<br>cyclohydrolase<br>deficiency |
| 111033765 | NM_000155.3(GALT):<br>c.812A>G<br>(p.Glu271Gly) | CGCYCAGCAGGGGTCAGCTCAGG | 1336 | Deficiency of<br>UDPglucose-hexose-<br>1-phosphate<br>uridylyltransferase |
| 121434606 | NM_006006.4(ZBTB16):<br>c.1849A>G<br>(p.Met617Val) | GATCAYGGCCGAGTAGTCCCGGG,<br>TGATCAYGGCCGAGTAGTCCCGG | 1337<br>1338 | Skeletal defects,<br>genital hypoplasia,<br>and mental<br>retardation |
| 566325901 | NM_000017.3(ACADS):<br>c.1108A>G<br>(p.Met370Val) | AGCCCAYGCCGCCCAGGATCTGG | 1339 | not provided |
| 148665132 | NM_012079.5(DGAT1):<br>c.751 + 2T>C | ACCGCGGYGAGGACCTCTGTGGG | 1340 | Diarrhea 7 |
| 111033830 | NM_000155.3(GALT):<br>c.574A>G<br>(p.Ser192Gly) | TGCYGGCCCATACCTGTCAAGGG,<br>CTGCYGGCCCATACCTGTCAAGG | 1341<br>1342 | Deficiency of<br>UDPglucose-hexose-<br>1-phosphate<br>uridylyltransferase |
| 28933679 | NM_000132.3(F8):<br>c.5600A>G<br>(p.His1867Arg) | GAGYGCACATCTTTTTCCTAGGG,<br>TGAGYGCACATCTTTTTCCTAGG | 1343<br>1344 | Hereditary factor VIII<br>deficiency disease |
| 137852251 | NM_000133.3(F9):<br>c.917A>G(p.Asn306Ser) | GCTGCAYTGTAGTTGTGGTGAGG | 1345 | Hereditary factor IX<br>deficiency disease |
| 141686175 | NM_001287223.1<br>(SCN11A):c.3473T>C<br>(p.Leu1158Pro) | CGTGCGCYGTCCCAGTTTGAAGG | 1346 | Episodic pain<br>syndrome, familial, 3 |
| 137852331 | NM_000402.4(G6PD):<br>c.583A>G<br>(p.Asn195Asp) | ATGCGGTYCCAGCCTCTGCTGGG | 1347 | Favism, susceptibility<br>to, Anemia,<br>nonspherocytic<br>hemolytic, due to G6PD<br>deficiency |
| 137852369 | NM_000132.3(F8):<br>c.5821A>G<br>(p.Asn1941Asp) | TAGCCATYGATTGCTGGAGAAGG | 1348 | Hereditary factor VIII<br>deficiency disease |
| 137852389 | NM_000132.3(F8):<br>c.398A>G(p.Tyr133Cys) | TCAYATTCAGCTCCTATAGCAGG | 1349 | Hereditary factor VIII<br>deficiency disease |
| 137852406 | NM_000132.3(F8):<br>c.940A>G(p.Thr314Ala) | TGAGCAGYAAGGAAAGTTATTGG | 1350 | Hereditary factor VIII<br>deficiency disease |

TABLE E-continued

List of disease-associated gene variants that could be base-edited
therapeutically with an NGG PAM positioned appropriately
(taken from Komor et al, Nature 2016, Suppl. FIG. 8)

| | | | |
|---|---|---|---|
| 28931576 | NM_000041.3(APOE): c.178A>G (p.Thr60Ala) | ACAGTGYCTGCACCCAGCGCAGG | 1351 |
| 74315301 | NM_000396.3(CTSK): c.990A>G (p.Ter330Trp) | GAGYCACATCTTGGGGAAGCTGG | 1352 Pyknodysostosis |
| 137852540 | NM_002764.3(PRPS1): c.341A>G (p.Asn114Ser) | TAGCATAYTTGCAACAAGCTTGG | 1353 Phosphoribosylpyro phosphate synthetase superactivity |
| 137852624 | NM_000215.3(JAK3): c.299A>G (p.Tyr100Cys) | AATCCTGYACAGCAGGACTTGGG | 1354 Severe combined immunodeficiency, autosomal recessive, T cell-negative, B cell-positive, NK cell-negative |
| 137852640 | NM_001166107.1 (HMGCS2):c.500A>G (p.Tyr167Cys) | ACCACCGYAGCAGGCATTGGTGG | 1355 mitochondrial 3-hydroxy- 3-methylglutaryl-CoA synthase deficiency |
| 137852814 | NM_005633.3(SOS1): c.1654A>G (p.Arg552Gly) | GCATCCYTTCCAGTGTACTCCGG | 1356 Noonan syndrome, Noonan syndrome 4, Rasopathy |
| 137852865 | NM_001171993.1(HPD): c.362A>G (p.Tyr121Cys) | CCTCAYATCCAGGCAAGAATTGG | 1357 4- Hydroxyphenylpyruvate dioxygenase deficiency |
| 370898981 | NM_138691.2(TMC1): c.1763 + 3A>G | TGGCCYACCAGATCATGCCTTGG | 1358 Deafness, autosomal recessive 7 |
| 118192167 | NM_000540.2(RYR1): c.14387A>G (p.Tyr4796Cys) | CCATAYACCAGCCCAGGTACAGG | 1359 Malignant hyperthermia susceptibility type 1, Central core disease |
| 137852972 | NM_032667.6(BSCL2): c.263A>G (p.Asn88Ser) | CGAGACAYTGGCAACAGGGAAGG | 1360 Distal hereditary motor neuronopathy type 5, Silver spastic paraplegia syndrome, Charcot-Marie-Tooth disease, type 2 |
| 118192193 | NM_172107.2(KCNQ2): c.356A>G (p.Glu119Gly) | CTTCYCATACTCCTTGATGGTGG, GCTCTTCYCATACTCCTTGATGG | 1361 Benign familial 1362 neonatal seizures 1 |
| 118192201 | NM_172107.2(KCNQ2): c.622A>G (p.Met208Val) | GGATCAYCCGCAGAATCTGCAGG | 1363 Benign familial neonatal seizures 1 |
| 137853027 | NM_001080463.1 (DYNC2H1):c.9044A>G (p.Asp3015Gly) | ATAYCTCTAATTACATCAGGTGG, AGAATAYCTCTAATTACATCAGG | 1364 Short-rib thoracic 1365 dysplasia 3 with or without polydactyly |
| 137853197 | NM_144573.3(NEXN): c.1955A>G (p.Tyr652Cys) | ATAYACTCTCCTCCATCTTCTGG | 1366 Dilated cardiomyopathy 1CC, Cardiomyopathy, not specified |
| 137853203 | NM_000476.2(AK1): c.491A>G (p.Tyr164Cys) | TTCTCAYAGAAGGCGATGACGGG, TTTCTCAYAGAAGGCGATGACGG | 1367 Adenylate kinase 1368 deficiency, hemolytic anemia due to |
| 786200859 | NM_000308.2(CTSA): c.746 + 3A>G | TCCCAYACCTGTTCCCCAGAAGG | 1369 Galactosialidosis, adult |
| 786200897 | NM_003494.3(DYSF): c.1285-2A>G | CAGCYAGAAGACACAGGGAGGGG, ACAGCYAGAAGACACAGGGAGGG, CACAGCYAGAAGACACAGGGAGG | 1370 Limb-girdle muscular 1371 dystrophy, type 2B 1372 |
| 786200928 | NM_206933.2(USH2A): c.7595-2144A>G | CTCTTAYCTTGGGAAAGGAGAGG | 1373 Usher syndrome, type 2A |

TABLE E-continued

List of disease-associated gene variants that could be base-edited
therapeutically with an NGG PAM positioned appropriately
(taken from Komor et al, Nature 2016, Suppl. FIG. 8)

| | | | | |
|---|---|---|---|---|
| 137853322 | NM_003639.4(IKBKG): c.1219A>G (p.Met407Val) | CCAYATCAGGGGCCTGATACTGG | 1374 | Incontinentia pigmenti syndrome |
| 387906267 | NM_000022.2(ADA): c.219-2A>G | CCCCYGGGAAGGGAAGAAAGGGG, GCCCCYGGGAAGGGAAGAAAGGG, AGCCCCYGGGAAGGGAAGAAAGG | 1375 1376 1377 | Severe combined immunodeficiency due to ADA deficiency |
| 387906362 | NM_000492.3(CFTR): c.3717 + 4A>G | TCAAATCYCACCCTCTGGCCAGG | 1378 | Cystic fibrosis |
| 397507442 | NM_002769.4(PRSS1): c.65A>G (p.Asp22Gly) | CTTGYCATCATCATCAAAGGGGG, TCTTGYCATCATCATCAAAGGGG, ATCTTGYCATCATCATCAAAGGG, GATCTTGYCATCATCATCAAAGG | 1379 1380 1381 1382 | Hereditary pancreatitis |
| 137853971 | NM_024598.3(USB1): c.502A>G (p.Arg168Gly) | CCACCYGGTTTTCTCTTGATTGG | 1383 | Poikiloderma with neutropenia |
| 2228063 | NM_000067.2(CA2): c.754A>G (p.Asn252Asp) | TGTYCTTCAGTGGCTGAGCTGGG, CTGTYCTTCAGTGGCTGAGCTGG | 1384 1385 | |
| 387906743 | NM_001376.4(DYNC1H1): c.2909A>G (p.Tyr970Cys) | ATTCAAGYAGATTACCTGATTGG | 1386 | Spinal muscular atrophy, lower extremity predominant 1, autosomal dominant |
| 387906772 | NM_002052.4(GATA4): c.928A>G (p.Met310Val) | TCCGCAYTGCAAGAGGCCTGGGG, TTCCGCAYTGCAAGAGGCCTGGG | 1387 1388 | Atrial septal defect 2 |
| 387906825 | NM_000414.3(HSD17B4): c.650A>G (p.Tyr217Cys) | TGCCACAYACTCTGGCTTCAGGG | 1389 | Gonadal dysgenesis with auditory dysfunction, autosomal recessive inheritance |
| 387906895 | NM_006587.3(CORIN): c.1414A>G (p.Ser472Gly) | GGATAACYTGTACTGTTGTAGGG | 1390 | Preeclampsia/ eclampsia 5 |
| 387906957 | NM_016013.3(NDUFAF1): c.758A>G (p.Lys253Arg) | ACCYTGACCTCCTGCCAGTAGGG, TACCYTGACCTCCTGCCAGTAGG | 1391 1392 | Mitochondrial complex I deficiency |
| 28933682 | NM_000132.3(F8): c.5822A>G (p.Asn1941Ser) | TAGCCAYTGATTGCTGGAGAAGG | 1393 | Hereditary factor VIII deficiency disease |
| 387907135 | NM_016464.4(TMEM138): c.389A>G (p.Tyr130Cys) | CAGYACAACACTGCTGCTGTGGG, GCAGYACAACACTGCTGCTGTGG | 1394 1395 | Joubert syndrome 16 |
| 137854530 | NM_001077488.3(GNAS): c.1A>G (p.Met1Val) | GCCCAYGGCGGCGGCGGCGGCGG | 1396 | Pseudohypopara- thyroidism type 1A |
| 387907176 | NM_018105.2(THAP1): c.70A>G (p.Lys24Glu) | CCTCACTYGTGGAAAGAAACGGG | 1397 | Dystonia 6, torsion |
| 137854593 | NM_000397.3(CYBB): c.1499A>G (p.Asp500Gly) | TCACAYCTTTCTCCTCATCATGG | 1398 | Chronic granulomatous disease, X-linked |
| 387907226 | NM_000076.2(CDKN1C): c.832A>G (p.Lys278Glu) | CGCTYGGCGAAGAAATCTGCGGG, GCGCTYGGCGAAGAAATCTGCGG | 1399 1400 | Intrauterine growth retardation, metaphyseal dysplasia, adrenal hypoplasia congenita, and genital anomalies |

TABLE E-continued

```
List of disease-associated gene variants that could be base-edited
        therapeutically with an NGG PAM positioned appropriately
              (taken from Komor et al, Nature 2016, Suppl. FIG. 8)
```

```
387907242 NM_022912.2(REEP1):    TCCYGTCAAAGGAAAAACAGAGG    1401 Distal hereditary
              c.304-2A>G                                           motor
                                                                   neuronopathy type 5B 387907291 NM_022787.3(NMNAT1):    TGTYTCTCTGCAAAGGGGCCAGG    1402 Leber congenital
              c.817A>G                                             amaurosis 9
              (p.Asn273Asp)

387907576 NM_001287.5(CLCN7):     TGTCAYAGTCCAAGCTCTGCAGG    1403 Osteopetrosis
              c.296A>G                                             autosomal
              (p.Tyr99Cys)                                         dominant type 2,
                                                                   Osteopetrosis
                                                                   autosomal
                                                                   recessive 4
```

```
#, SEQ ID NO:
```

EXAMPLES

The invention is further described in the following examples, which do not limit the scope of the invention described in the claims.

Methods

The following materials and methods were used in the Examples set forth below.

Molecular Cloning

Expression plasmids were constructed by selectively amplifying desired DNA sequences using the PCR method such that they had significant overlapping ends and using isothermal assembly (or "Gibson Assembly", NEB) to assemble them in the desired order in a CAG or CMV expression vectors. PCR was conducted using Phusion HF polymerase (NEB). Cas9 gRNAs were cloned into the pUC19-based entry vector BPK1520 (via BsmBI) under control of a U6 promoter.

```
Guide RNAs
All gRNAs were of the form
                                          (SEQ ID NO: 140)
5'-NNNNNNNNNNNNNNNNNNNNNNCGTTTTAGAGCTAGAAATAGCAAG

TTAAAATAAGGCTAGTCCGTTATCAACTTGAAAAAGTGGCACCGAGT

CGGTGCTTTTTTT-3'.

Shown below are the protospacer regions
(NNNNNNNNNNNNNNNNNNNNN in SEQ ID NO: 141)
for these gRNAs (all written 5' to 3').

Cas9 guide RNA 1 protospacer, non-targeting:
                                          (SEQ ID NO: 103)
GGAGACGATTAATGCGTCTCC Cas9 guide RNA 2 protospacer, RNF2 site 1:
                                          (SEQ ID NO: 104)
GTCATCTTAGTCATTACCTG Cas9 guide RNA 3 protospacer, EMX1 site 1:
                                          (SEQ ID NO: 105)
GAGTCCGAGCAGAAGAAGAA Cas9 guide RNA 4 protospacer, EMX1 site 2:
                                          (SEQ ID NO: 106)
GTATTCACCTGAAAGTGTGC Cas9 guide RNA 5 protospacer, FANCF site 1:
                                          (SEQ ID NO: 107)
GGAATCCCTTCTGCAGCACC
```

```
                        -continued
Cas9 guide RNA 6 protospacer, HEK site 2:
                                          (SEQ ID NO: 108)
GAACACAAAGCATAGACTGC Cas9 guide RNA 7 protospacer, HEK site 3:
                                          (SEQ ID NO: 109)
GGCCCAGACTGAGCACGTGA Cas9 guide RNA 8 protospacer, HEK site 4:
                                          (SEQ ID NO: 110)
GGCACTGCGGCTGGAGGTGG Cas9 guide RNA 9 protospacer, PPP1R12C site 1:
                                          (SEQ ID NO: 111)
GACTCACCCAGGAGTGCGTT Cas9 guide RNA 10 protospacer, PPP1R12C site 2:
                                          (SEQ ID NO: 112)
GGCACTCGGGGGCGAGAGGA Cas9 guide RNA 11 protospacer, PPP1R12C site 3:
                                          (SEQ ID NO: 113)
GAGCTCACTGAACGCTGGCA Cas9 guide RNA 12 protospacer, PD1 site 1:
                                          (SEQ ID NO: 114)
CGTGACTTCCACATGAGCG
(Guide RNA 12 is described in Su et al,
Sci Rep 2016; PMID 26818188)

Cas9 guide RNA 13 protospacer, VEGFA site2:
                                          (SEQ ID NO: 115)
GACCCCCTCCACCCCGCCTC
```

Cell Culture and Transfections

HEK293T cells (CRL-3216, obtained from ATCC) were grown in culture using media consisting of Advanced Dulbeccos Modified Medium (Gibco) supplemented with 10% FBS (Gibco) and 1% penicillin-streptomycin solution (Gibco). Cells were passaged at ~80% confluency every 2-3 days to maintain an actively growing population and avoid anoxic conditions. HepG2 cells (HB80-65, obtained from ATCC) were grown in Eagle's Minimum Essential Medium (ATCC) supplemented with 10% FBS and 0.5% penicillin-streptomycin solution (Gibco). Cells were passaged at ~80% confluency every 4 days. Both cell lines were used for experiments until passage 20 for HEK293T and passage 12 for HepG2. Cells were tested for mycoplasma bi-weekly.

For sorting experiments, transfections with 50 ug of transfection quality DNA (Qiagen Maxiprep) encoding desired BE3-P2A-EGFP fusion proteins or controls and gRNAs (75:25%) were conducted by seeding $6 \times 10^6$ HEK293T or $15 \times 10^6$ HepG2 into TC-treated 150 mm plates 18-24 h prior to transfection to yield ~80% confluency on the day of transfection. Cells were transfected at 60-80% confluency using TransIT-293 (HEK293T, Mirus) or tranfeX (HepG2, ATCC) reagents according to the manufacturers' protocols. To ensure maximal correlation of negative controls to BE overexpression, cells of the same passage were transfected with nCas9-UGI-NLS (negative control) and base editors in parallel. RNA and gDNA was harvested after cell sorting. For experiments validating DNA on-target activity of SECURE-BE variants, $1.5 \times 10^4$ HEK293T cells were seeded into the wells of a 96-well plate and transfected 18-24 h after seeding with 220 ng DNA (BE3/nCas9-UGI: gRNA ration of 75:25%). In this context, gDNA was harvested 72 h post-transfection.

FACS & RNA/DNA Harvest

Sorting of negative control and BE expressing cells as well as RNA/DNA harvest were carried out on the same day. Cells were sorted on an BD FACSARIAII 36-40 h after transfection. We gated on the cell population on forward/sideward scatter after exclusion of doublets. We then sorted all GFP-positive cells and/or top 5% of cells with the highest FITC signal into pre-chilled 100% FBS and 5% of mean fluorescence intensity (MFI)-matched cells for nCas9-UGI negative controls, matching the MFI/GeoMean of top 5% of BE3-transfected cells. We used MFI-matching for these controls, as the nCas9-UGI-P2A-EGFP plasmid is smaller than BE3-P2A-EGFP-due to the lack of rAPOBEC1—and thus yields higher transfection efficiency and overall higher FITC signal. After sorting, cells were spun down, lysed using DNA lysis buffer (Laird et al, 1991) with DTT and Proteinase K or RNA lysis buffer (Macherey-Nagel). gDNA was extracted using magnetic beads (made from FisherSci Sera-Mag SpeedBeads Carboxyl Magnetic Beads, hydrophobic according to Rohland & Reich, 2012), after overnight lysis. RNA was extracted with Macherey-Nagel's NucleoSpin RNA Plus kit.

High-Throughput Amplicon Sequencing, RT-PCR & Base Editing Data Analysis

Target site genomic DNA was amplified using gene-specific DNA primers flanking desired target sequence. These primers included illumina-compatible adapter-flaps. The amplicons were molecularly indexed with NEBNext Dual Index Primers (NEB) or index primers with the same or similar sequence ordered from IDT. Samples were combined into libraries and sequenced on the Illumina MiSeq machine using the MiSeq Reagent Kit v2 or Micro Kit v2 (Illumina). Sequencing results were analyzed using a batch version of the software CRISPResso 2.0 beta (crispresso.rocks). Reverse transcription was performed using the High Capacity RNA-to-cDNA kit (Thermo Fisher) following the manufacturer's instructions. Amplicon PCR and library preparation for Next-Generation Sequencing (NGS) off of cDNA was done as described above for gDNA (e.g. for the apoB amplicon around C6666). If possible, we used exon-exon junction spanning primers to exclude amplification of gDNA traces.

RNA-seq and Single Nucleotide Variant Calling

RNA library preparation was performed using Illumina's TruSeq Stranded Total RNA Gold Kit with initial input of 500 ng of extracted RNA per sample, using SuperScript III for first-strand synthesis (Thermo Fisher). rRNA depletion was confirmed during library preparation on a High Resolution QIAxcel (Qiagen) automated electrophoresis device and/or by fluorometric quantitation using the Qubit HS RNA kit before and after depletion (Thermo Fisher). For indexing, we used IDT-Illumina Unique Dual Indeces (Illumina). Libraries were pooled based on qPCR quantification (NEB- Next Library Quant Kit for Illumina) and loaded onto a NextSeq (at MGH Cancer Center, PE 2×150, 500/550 Mid-Output Cartridge) or HiSeq2500 in High Output mode (Broad Institute, PE 2×76). Illumina fastq sequencing reads were aligned to the human hg38 reference genome with STAR (Dobin et al., 2013, PMID: 23104886) and processed with GATK best practices (McKenna et al., 2010, PMID: 20644199: DePristo et al., 2011, PMID: 21478889). RNA variants were called using HaplotypeCaller, and empirical editing efficiencies were established on PCR-de-duplicated alignment data.

Variant loci in BE overexpression experiments were further required to have comparable read coverage in the corresponding control experiment (read coverage for SNV in control >90th percentile of read coverage across all SNVs in overexpression). Additionally, the above loci were required to have a consensus of at least 99% of reads calling the reference allele in control.

Protein Model and DNA/RNA Binding Prediction

The rAPOBEC1 amino acid sequence was obtained from uniprot and entered into the Phyre2 interface (Kelley L A et al. Nature Protocols 10, 845-858 2015) to obtain a protein model prediction. Three-dimensional distribution of residues in this predicted model were analyzed using the software PyMOL (Schrödinger). DNA and RNA binding was predicted using the DRNApred web interface (Yan&Kurgan, N A R 2017).

Alignment of APOBEC Homologues and Orthologues rAPOBEC1 was aligned to other APOBEC1 homologues or other members of the human APOBEC family using Geneious 7 software.

Cell Viability Assay

HEK293T ($2.5 \times 106$ cells) cells were seeded into 100 mm TC-treated culture dishes (Fisher) 24 h prior to transfection. Cells were transfected in triplicate with 16.5 μg of BE3, BE3 (E63Q), SECURE-BE3 or negative control plasmids as well as 5.5 μg of guide RNA expression plasmid (RNF2 site1), and 66 μL TransIT-293T. Cells were incubated for 36 h post-transfection, followed by sorting for GFP-positive cells (as described in FACS Methods). After sorting, cells were counted using a LUNA-FL Cell Counter (Logos Biosystems) with Acridine Orange/Propidium Iodide Stain. $5 \times 103$ viable cells were seeded into 96-well solid white TC treated microplates (Corning) in 100 μL DMEM; each condition was seeded into 3 wells for technical triplicates per biological replicate (n=3 biologically independent samples), and 4 plates of cells were prepared from this experiment for 4 different endpoints (d1-d4). At 24 h, 48 h, 72 h, and 96 h post-sorting, cell viability was determined using the Cell-Titer-Glo Luminescent Cell Viability Assay reagent (Promega). After the plate was equilibrated at room temperature for 30 minutes, 100 μL of 1:5 diluted CellTiter-Glo reagent were directly added to each well (adapted from ref. 45). After 2 minutes of plate shaking on the Synergy HT microplate reader (BioTek), plates were incubated at room temperature for 10 minutes, and read with the Synergy HT for luminescence. The luminescence background (average of 8 empty wells per plate) was subtracted from all luminescence values generated in the respective plate. Cells were not seeded at the edge of the plate (columns 1 and 12 as well as rows A and H).

Statistical Testing for Differences in the Cell Viability Assay Data

We fit a linear mixed effects model using the R nlme package with log 2 (RLU) as the outcome to assess the effect on cell viability of each base editor variant compared to nCas9-UGI-NLS. A random effect for biological replicate was used to account for the correlation between technical replicates. P-values represent the significance of the fixed effect coefficient encoding the base editor in the mixed-effects models.

Figure 2:
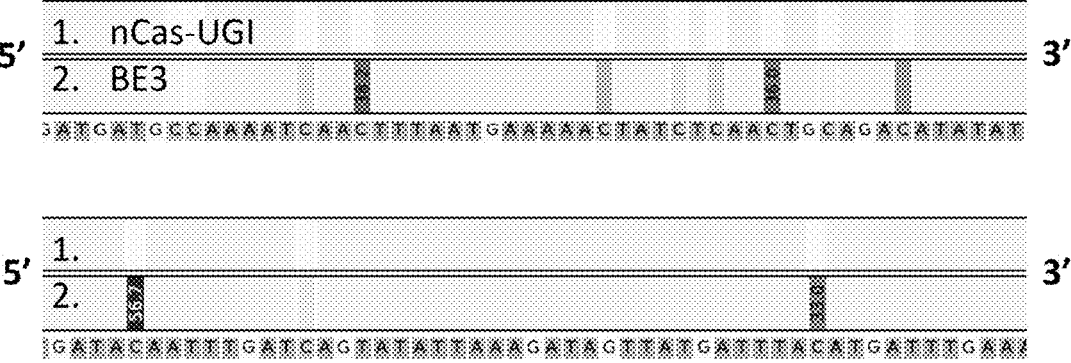
FIG. 2. BE3 edits APOB transcript. APOB is known to be physiologically edited by APOBEC1, predominantly at chr2:21010330 (C6666, arrow) although other neighboring cytosines can also be edited to a lesser extent. NGS shows C-to-U transitions (shown as C-to-T in shades of gray because sequencing is done on DNA that is reverse transcribed from RNA) induced on APOB transcript by BE3 overexpression. By comparison, note that nCas9-UGI-NLS (BE3 lacking rAPOBEC1) overexpression does not lead to C to U changes on APOB RNA.

Example 1. Base Editor Fusions Comprised of Wild-Type APOBEC1 Induce Unwanted C to U Edits in RNA To test whether BE3 might be capable of editing cytosines in RNA, we first assessed whether this base editor fusion could edit the C6666 nucleotide in APOB mRNA previously shown to be edited by isolated rAPOBEC1. To do this, we transfected human HepG2 cells with a plasmid that expressed a BE3-P2A-EGFP fusion protein (the P2A sequence mediates a post-translational cleavage that releases EGFP from the BE3 part of the fusion) (Methods). At 36 hours after transfection, we then used flow cytometry to sort out the highest expressing (top 5%) of GFP-positive cells and isolated total RNA from these cells. As a negative control, we transfected HepG2 cells in parallel with a plasmid that expressed a nickase Cas9 (nCas9)-UGI-P2A-EGFP fusion protein (i.e., a plasmid identical to the BE3-P2A-EGFP expression plasmid but lacking the rAPOBEC1 and XTEN-linker within the BE3 part of the fusion protein) and also sorted these for the top 5% GFP-positive cells and isolated total RNA. We assessed the RNA sequence of the human APOB transcript that encompasses the C6666 previously shown to be deaminated by rAPOBEC1 in these samples using reverse transcription followed by targeted amplicon sequencing of this region (Methods). Consistent with previous studies of isolated rAPOBEC1 overexpression, we found that BE3 not only edited C6666 to a U with high efficiency (~55%) in the APOB mRNA transcript but that it also edited other proximal Cs that were preceded by an A as well (FIG. 2). The negative control cells expressing nCas9-UGI did not show evidence of RNA editing at any of these Cs, demonstrating that this activity was caused by the rAPOBEC1 present in BE3. Furthermore, because we did not express any guide RNA in this experiment, this unwanted RNA editing activity does not appear to be dependent on RNA-guided targeting by the nCas9 part of BE3. We concluded that BE3, like isolated rAPOBEC1, can deaminate multiple Cs within the APOB mRNA transcript with high efficiency.

Figure 3:
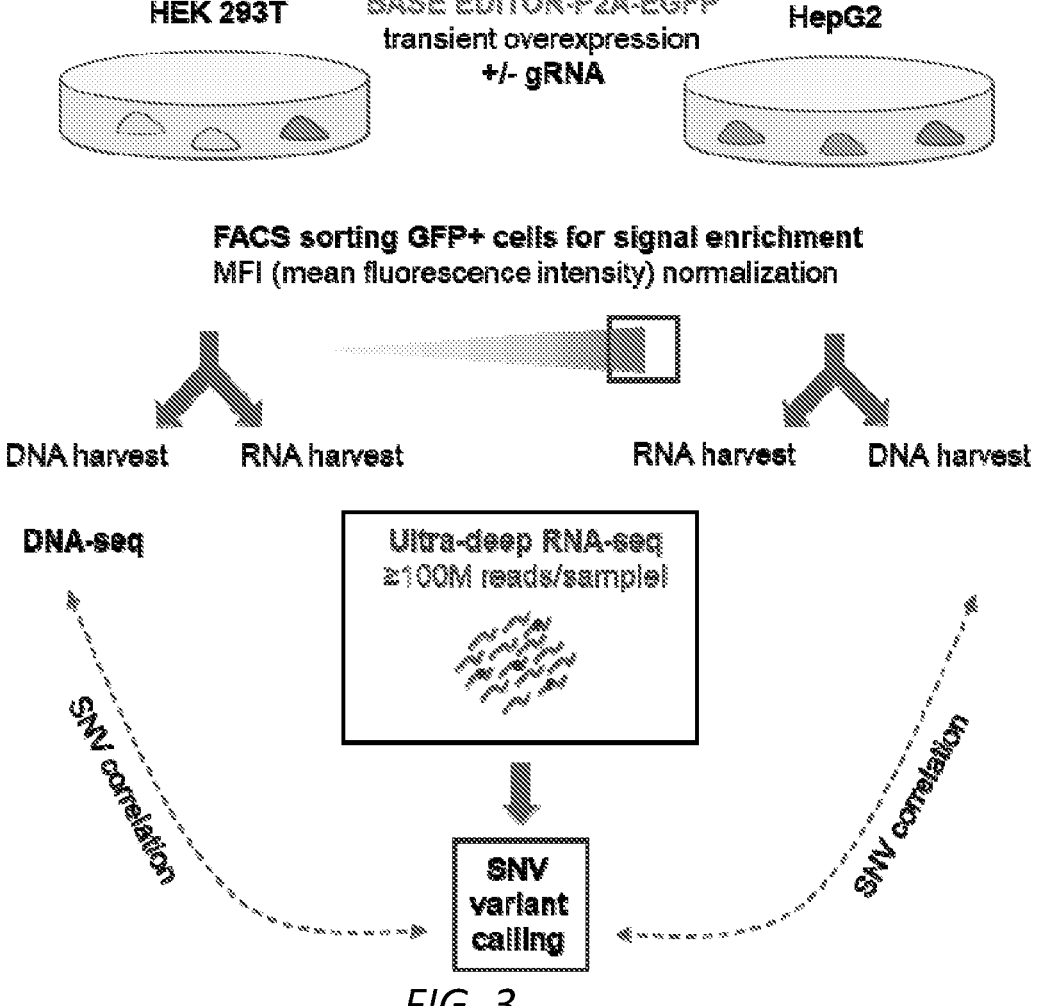
FIG. 3. Schematic of experimental design of RNA-seq experiments to assess potential RNA editing by BE3. Two human cell lines, HEK 293T and HepG2, were transiently transfected with plasmids encoding BE3 base editors fused to P2A-EGFP and with or without another plasmid encoding a guide RNA. After 36-40 hours of incubation, the cells are sorted by FACS collecting GFP-positive cells (all-GFP or top 5%, after gating for the cell population and doublet exclusion), followed by cell lysis for DNA and RNA extraction. RNA was then sequenced by ultra-deep RNA-seq (>=100M reads per sample) for SNV variant calling. Targeted amplicon sequencing or whole-exome sequencing was performed (DNA-seq) to rule out the alternate possibility that C to T mutations on the DNA account for the changes observed on RNA.

To test whether BE3 might edit Cs in other mRNA transcripts, transcriptome-wide experiments using ultra-deep RNA-seq were performed in two human cell lines (HEK293T and HepG2 cells). In these experiments (as illustrated in FIG. 3), cells were transfected with plasmids expressing BE3-P2A-EGFP or nCas9-UGI-P2A-EGFP and a gRNA targeted to a site in the RNF2 gene. These transfected cells were then flow sorted for the top 5% GFP-positive cells (or 5% MFI-matched to BE3 in case of the nCas9-UGI negative control) at 36-40 hours post-transfection and total RNA was isolated from these sorted cells. Using ultra-deep RNA-seq performed with HiSeq2500 (Methods), we found that by far the most common RNA nucleotide substitutions in cells expressing BE3 (relative to control cells expressing nCas9-UGI) were C to U or G to A changes (FIGS. 4A-B). (G to A changes are actually C to U changes on RNA that map to the minus strand of reference genome sequence after reverse transcription and therefore hereafter we collectively refer to all C to U and G to A edits as simply C to U edits.) Strikingly, a large number of Cs that were significantly edited to Us in cells expressing BE3 relative to cells expressing nCas9-UGI were identified: ~150,000 and ~30,000 in HEK293T and HepG2 cells, respectively (Table 1).

TABLE 1

| Total numbers of C > U RNA edits induced by BE3 overexpression | | | | | |
|---|---|---|---|---|---|
| | | | | C > U Variants | |
| Cell Line | Guide RNA | Replicate No. | +Strand (C > U) | −Strand (G > A) | Total |
| 293T | RNF2, site1 | #1 | 81340 | 78076 | 159416 |
| | | #2 | 71691 | 68839 | 140530 |
| 293T | EMX1, site1 | #1 | 70372 | 67553 | 137925 |
| | | #2 | 56576 | 54354 | 110930 |
| 293T | Non-targeting | #1 | 67082 | 64839 | 131921 |
| | | #2 | 75263 | 72649 | 147912 |
| HepG2 | RNF2, site1 | #1 | 29069 | 29303 | 58372 |
| | | #2 | 14129 | 14707 | 28836 |

Total transcriptome-wide numbers of edited cytosines in different biological replicates and in experiments using different gRNAs (including a non-targeting gRNA) and/or different human cell lines. Edited cytosines map to + and − strands of DNA differently following reverse transcription with C to U RNA edits showing as G to A edits when mapped to the - DNA strand of reference sequence. Cells were transfected 18-24 h after seeding and sorted 36-40 h after transfection for top 5% FITC signal.

These edited Cs were distributed throughout the human genome (FIGS. 4A-B), had editing efficiencies ranging from <5 to >85% in HEK293T cells and <5 to >60% in HepG2 cells (FIGS. 4A-B), and were enriched in the 3' end of mRNA transcripts (FIGS. 4A-B). The preference for editing of Cs at the 3' end of transcripts is consistent with previously published descriptions of this same pattern when isolated APOBEC1 was overexpressed in mammalian cells[23]. In addition, sequence logos derived from edited Cs in each of these experiments showed the high prevalence of an A preceding the edited C (FIGS. 4A-B), another finding consistent with previously characterized editing activity of isolated APOBEC1 in mammalian cells[22, 24]. Similar results were observed when this same experiment was performed in HEK293T cells with a gRNA to a site in the human EMX1 gene or with a gRNA that is targeted to a site that is not present in the human genome (FIGS. 5A-B). Taken together, we conclude that base editor fusions harboring APOBEC1 can efficiently and robustly induce a very large number of C to U edits in RNA on a transcriptome-wide scale.

Example 2. APOBEC1 Base Editor Variants with Reduced RNA Editing Activities

Given the extensive transcriptome-wide RNA editing induced by BE3, we sought to create variants of this base editor that would diminish this unwanted activity while retaining the desired capability to perform targeted DNA base editing. We reasoned that the introduction of mutations into the APOBEC1 part of a base editor might accomplish this. A previously published study described a series of 16 different amino acid substitutions in APOBEC1 that had been suggested to confer reduced RNA binding capability, reduced binding to auxiliary co-factors or reduced dimerization potential[25-29] in isolated APOBEC1; however, these mutants had not been characterized for their RNA editing activities in the context of a base editor fusion nor had they been characterized for the desired retention of DNA editing capabilities in the context of a base editor fusion. As a result, it was unknown and unclear which mutations in the context of a base editor would have the desired combined properties of reduced RNA editing but preserved targeted DNA editing.

Figure 6:
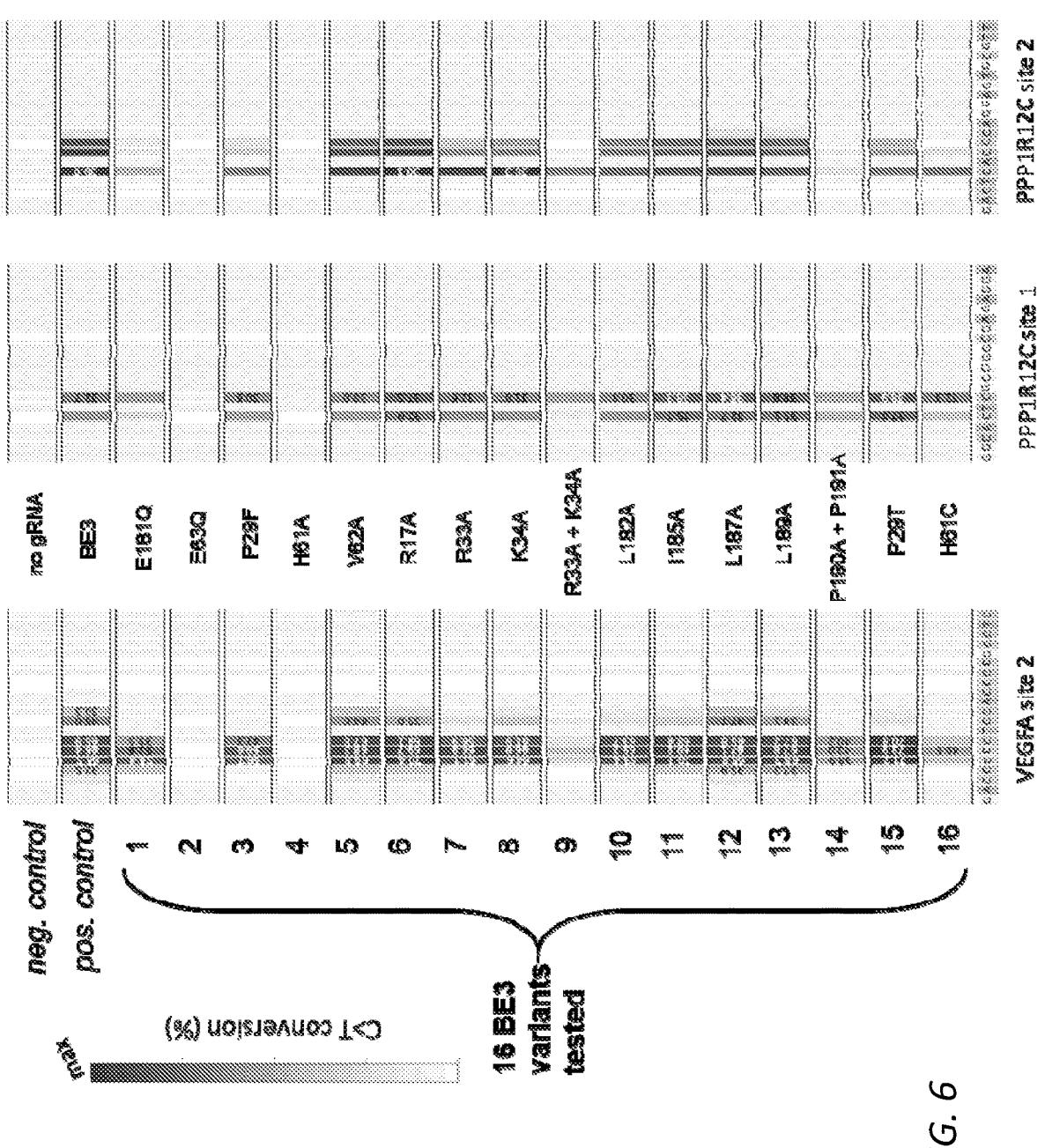
FIG. 6. Initial screen of base editor variants to assess DNA base editing efficiencies. 16 BE3 variants harboring rAPOBEC1 mutations that were hypothesized to alter the RNA editing activities of rAPOBEC1 were tested for their DNA editing activities when co-expressed with three different gRNAs (targeted to sites in the human VEGFA and PPP1R12C genes) relative to a nCas9-UGI-NLS (negative control) and wild-type BE3 (positive control). C to T editing efficiencies are presented in heat map format, with darker color indicating higher efficiencies.

To begin to assess phenotypic behavior of the 16 previously described APOBEC1 mutations on base editor activities, we constructed a series of 16 BE3 fusions harboring the following amino acid substitutions in the APOBEC1 part of the protein (numbering of amino acid residues refers to the rAPOBEC1 sequence): R17A, P29F, P29T, R33A, K34A, R33A+K34A (double mutant), H61A, H61C, V62A, E63Q, E181Q, L182A, 1185A, L187A, L189A, and P190A+ P191A (double mutant). These variants were initially screened for their abilities to induce targeted DNA edits using three gRNAs targeted to different endogenous human genes (FIG. 6). To do this, we transfected HEK293T cells with plasmids expressing a gRNA and wild-type BE3 or a BE3 variant harvested genomic DNA 72 hours following transfection and examined the target DNA site for evidence of base editing using targeted amplicon sequencing with MiSeq (Methods). This experiment revealed that at least 12 of the variants we tested (R17A, P29F, P29T, R33A, K34A, R33A+K34A (double mutant), H61C, V62A, L182A, 1185A, L187A, and L189A) showed DNA editing reasonably comparable to what was observed with wild-type BE3 at the three sites tested (FIG. 6). We excluded the R17A, V62A and L187A variants because a previously published report[28] showed that these three variants still possess RNA editing activities, leaving a total of nine variants to carry forward for further characterization (P29F, P29T, R33A, K34A, R33A+K34A (double mutant), H61C, L182A, 1185A, and L189A). We also included E181Q (for a total of ten variants) because it provided a good positive control for lower RNA editing activity.

Figure 7A:
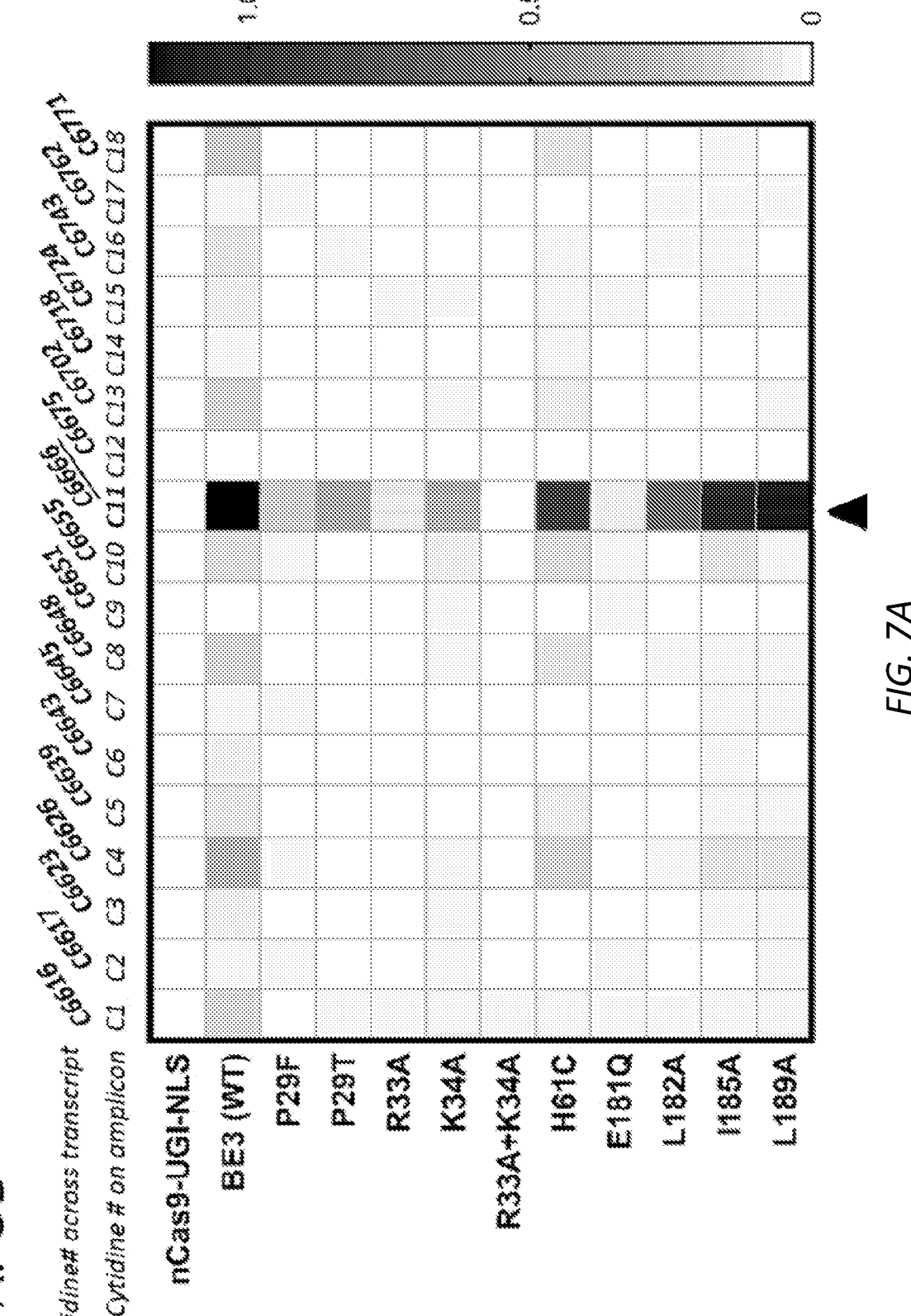
FIGS. 7A-E. Assessment of the RNA editing activities of base editor variants on the APOB transcript. (A) Ten BE3 variants harboring rAPOBEC1 mutations that were tested for DNA editing activities in FIG. 7 above were assessed for their abilities to edit cytosines in the human APOB mRNA transcript in HepG2 cells. In addition, nCas9-UGI-NLS (negative control) and wild-type (WT) BE3 (positive control) were also assessed for their RNA editing activities on APOB mRNA. C to U editing efficiencies are presented in heat map format, with darker color indicating higher efficiencies. The heat map shows all cytidines across a ~200 base pairs (bp) RNA sequence around cytidine 6666 (C6666) of the APOB transcript, which has been demonstrated to be physiologically edited by APOBEC1 in intestinal cells (genomic location: chr2:21010330). All values were normalized to the negative control (nCas9-UGI-NLS, defined as 0% editing) and WT BE3 (defined as 100%). The arrowhead indicates C6666, which has been demonstrated to be physiologically edited by APOBEC1 in human intestinal cells (genomic location: chr2:21010330, Chen et al, Science 1987). (B) Jitter plots from RNA-seq experiments in HEK293T cells showing RNA cytosines modified by expression of wild-type (WT) BE3, BE3-R33A. BE3-R33A/K34A, or BE3-E63Q. Y-axis represents the efficiencies of C-to-U RNA editing. n=total number of modified cytosines observed. (C) Manhattan plots showing the distribution of modified cytosines induced by BE3-R33A and BE3-R33A/K34A from replicate 2 in (B) overlaid on modified cytosines induced by WT BE3 (note that the WT BE3 data is the same in the top and bottom plots). (D) Jitter plots from RNA-seq experiments in HepG2 cells showing RNA cytosines modified by WT BE3, BE3-R33A and BE3-R33A/K34A. Y-axis represents the efficiencies of C-to-U RNA editing. WT BE3 data are from the same experiments presented in FIG. 1c (Reps. 2-4). n=total number of modified cytosines observed (E) Manhattan plots of data showing the distribution of modified cytosines induced by BE3-R33A and BE3-R33A/ K34A for replicate 3 from (D) overlaid on modified cytosines induced by WT BE3 (note that the WT BE3 data is the same in the top and bottom plots). n=total number of modified cytosines.

We next assessed these ten BE3 variants for their RNA editing activities. We initially examined their abilities to edit the C6666 base and other adjacent Cs within the APOB mRNA transcript in human cells. To do this, HepG2 cells were transfected with plasmid expressing wild-type BE3 or a BE3 variant. RNA was harvested after 24 h (no sorting), followed by reverse transcription and targeted amplicon sequencing of a 200 bp region encompassing C6666 on the APOB transcript (Methods). This experiment revealed that seven of these BE3 variants (P29F, P29T, R33A, K34A, R33+K34A (double mutant), E181Q and L182A) showed relative reductions in RNA editing activities at these cytosines compared with wild-type BE3 (FIG. 7A).

We next performed transcriptome-wide analysis of RNA editing with overexpression of six of these variants in human cells, excluding E181Q due to its low DNA editing capabilities. This was done by transfecting HEK293T cells with plasmids expressing wild-type BE3 or a BE3 variant as P2A fusions to EGFP and a RNF2-targeted gRNA, sorting for the top 5% of GFP expressing cells 36 hours after transfection, isolating total RNA, and carrying out RNA-seq with 20 million reads/sample (using NextSeq) (Methods). This experiment demonstrated that all six variants showed substantially reduced transcriptome-wide RNA editing activities relative to wild-type BE3 and that the P29F and R33A+ K34A variants in particular had activities similar to a BE3 harboring a E63Q active site mutation previously shown to completely abolish cytosine deaminase activity of APOBEC1 26, 28 (Table 2).

TABLE 2

| Base Editor | C > U Variants | | |
| | +Strand (C > U) | −Strand (G > A) | Total |
| --- | --- | --- | --- |
| BE3 | 34882 | 34741 | 69623 |
| BE3(E63Q) (deaminase-negative | 30 | 46 | 76 |

TABLE 2-continued

| Base Editor | C > U Variants | | |
| | +Strand (C > U) | −Strand (G > A) | Total |
| --- | --- | --- | --- |
| control) | | | |
| BE3(P29F) | 27 | 36 | 63 |
| BE3(P29T) | 142 | 158 | 300 |
| BE3(L182A) | 1057 | 1071 | 2128 |
| BE3(R33A) | 210 | 225 | 435 |
| BE3(K34A) | 2929 | 2736 | 5665 |
| BE3(R33A + K34A) | 23 | 40 | 63 |

Total transcriptome-wide number of edited cytosines observed with SECURE-BE variants compared with wild-type BE3 and the catalytically inactive E63Q variant. All experiments were performed in human HEK 293T cells with a gRNA targeted to the human RNF2 gene co-expressed in the cells. Cytosines that map to different DNA strains following reverse transcription are listed in the two columns.

Figure 7B:
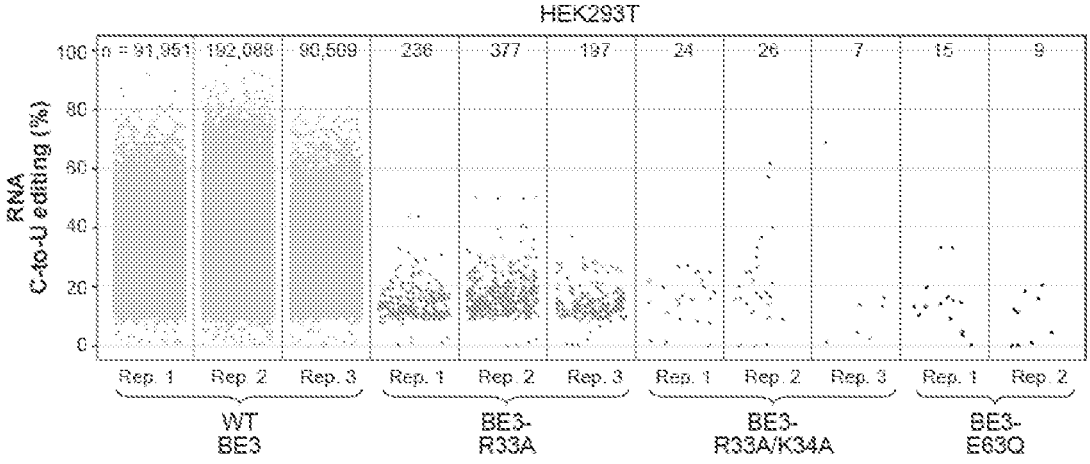
Figure 7C:
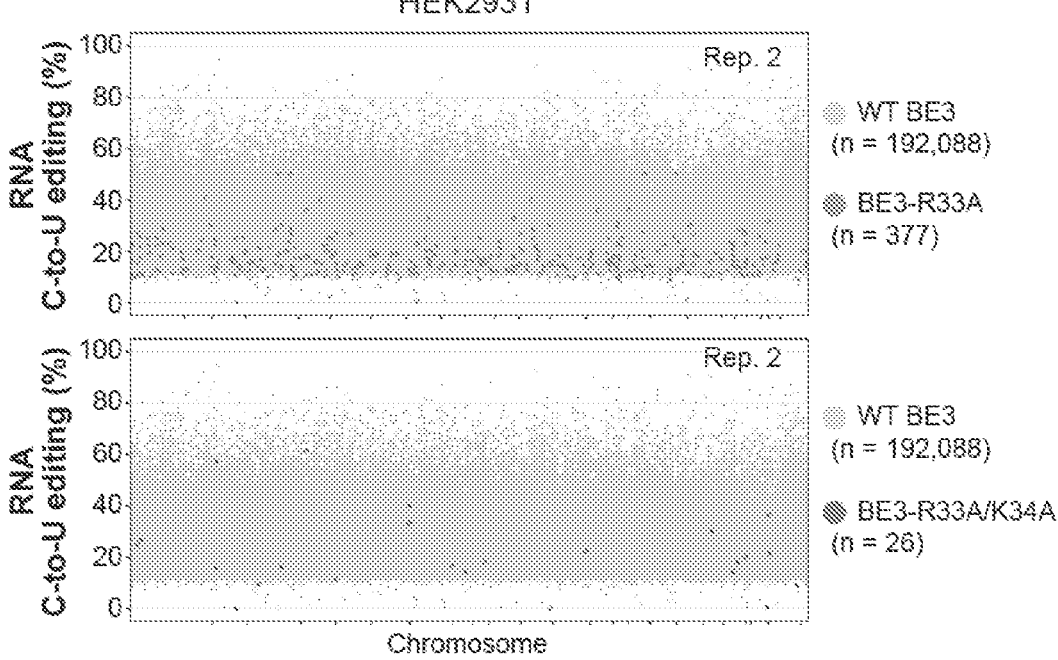
Figure 7D:
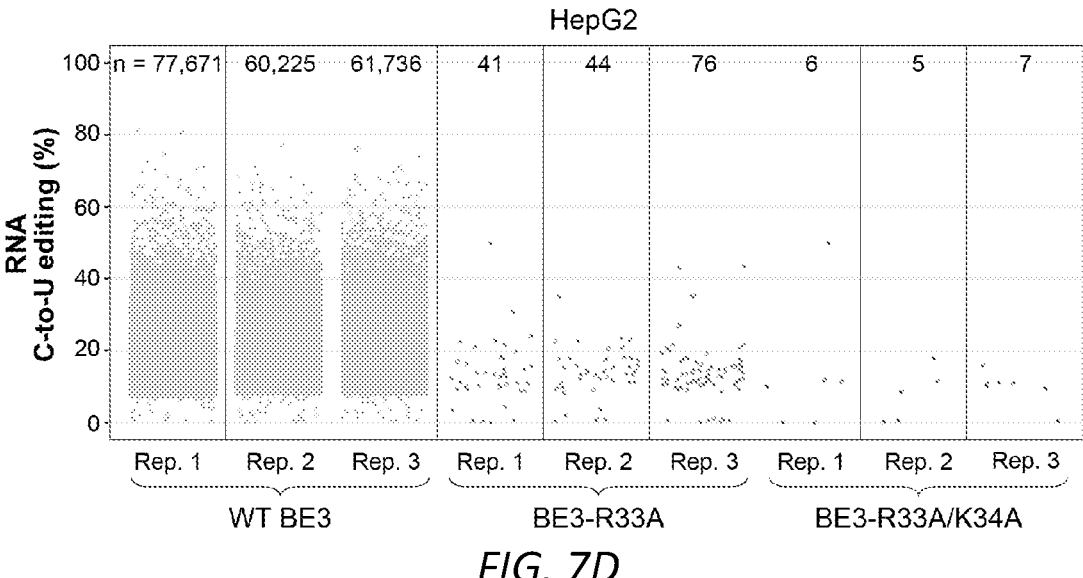
Figure 7E:
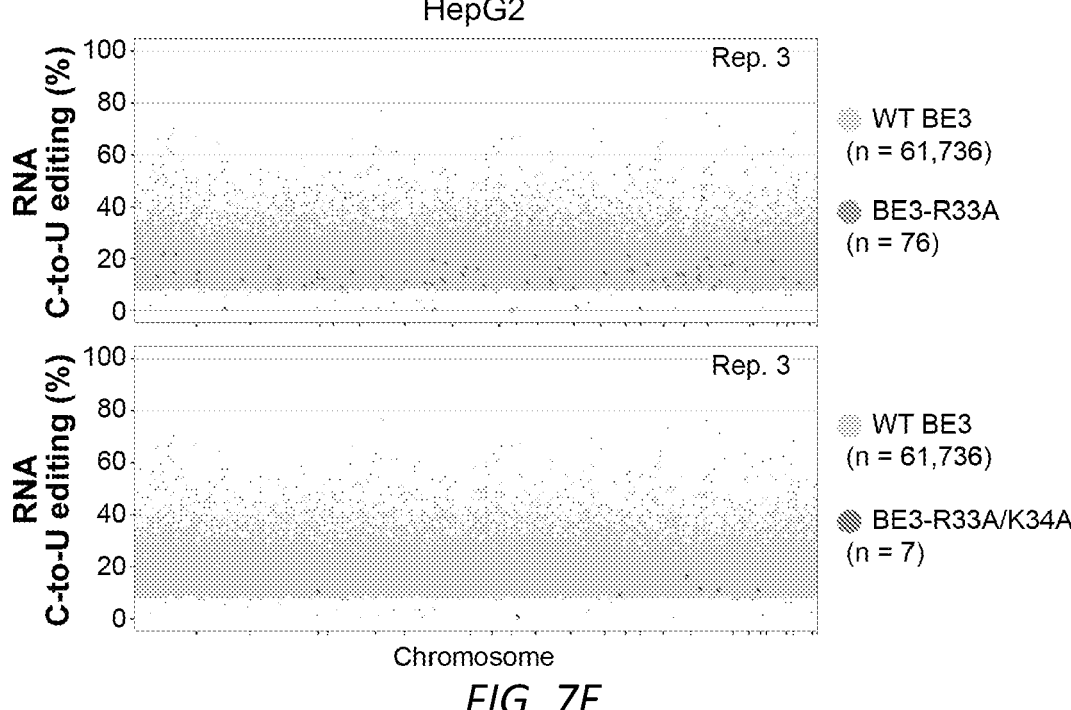

To more rigorously characterize RNA editing by these two variants, we performed RNA-seq experiments with the RNF2 gRNA using transfected HEK293T cells sorted for high-level expression of wild-type BE3, BE3-R33A, BE3-R33A/K34A, or a catalytically impaired BE3-E63Q mutant (Navaratnam et al, Cell. 1995 Apr. 21; 81(2):187-95). For these studies, we used high expression conditions (top 5% sorting) to enable the most sensitive detection of any residual RNA editing by these variants. We observed dramatic reductions in the number of transcriptome-wide C-to-U edits with BE3-R33A inducing only hundreds and BE3-R33A/K34A inducing 26 or fewer of such edits (FIGS. 7B and 7C). The number of edits observed with BE3-R33A/K34A were similar to the baseline number seen with the catalytically impaired BE3-E63Q mutant (FIG. 7B). On-target DNA editing efficiency of the variants was comparable to WT BE3 with the RNF2 gRNA in HEK293T cells. Testing of BE3-R33A and BE3-R33A/K34A with the RNF2 gRNA in HepG2 cells also demonstrated dramatically reduced numbers of RNA edits throughout the transcriptome (FIGS. 7D and 7E) but on-target DNA editing rates similar to those of wild-type BE3 with both variants. This data shows how much better (300-3000×) the variants are on RNA.

Importantly, examination of the on-target RNF2 DNA site in these same cells showed that all six variants retained DNA base editing activities and also perhaps possessed a more narrowed editing window (FIG. 8). Notably, within this narrowed window, the R33A, K34A, and R33A+K34A variants exhibited DNA base editing activities comparable to wild-type BE3 (FIG. 8).

We next sought to characterize targeted DNA editing activities of the six BE3 variants as well as E181Q with a larger series of gRNAs and under conditions in which we did not select cells for overexpression via sorting of GFP positive cells. To do this, we transfected HEK293T cells with plasmids expressing one of 12 different gRNAs and wild-type BE3 or a BE3 variant, harvested genomic DNA 72 hours following transfection without flow sorting, and examined the target DNA site for evidence of base editing using targeted amplicon sequencing with MiSeq (Methods). These experiments show that the BE3 variants harboring the R33A, K34A, R33A+K34A, or L182A mutations consistently show high targeted DNA editing activities comparable to wild-type BE3 across a range of sides, in some cases again showing a more narrowed window of editing at these sites as well as reduced insertion/deletion (indel) profiles as seen on VEGFA site 2. We conclude that the base editor variants described here possess reduced RNA editing activities while still retaining targetable sequence-specific DNA editing activities and we therefore refer to these as SElective Curbing of Unwanted RNA Editing (SECURE) base editor variants.

Figure 10:
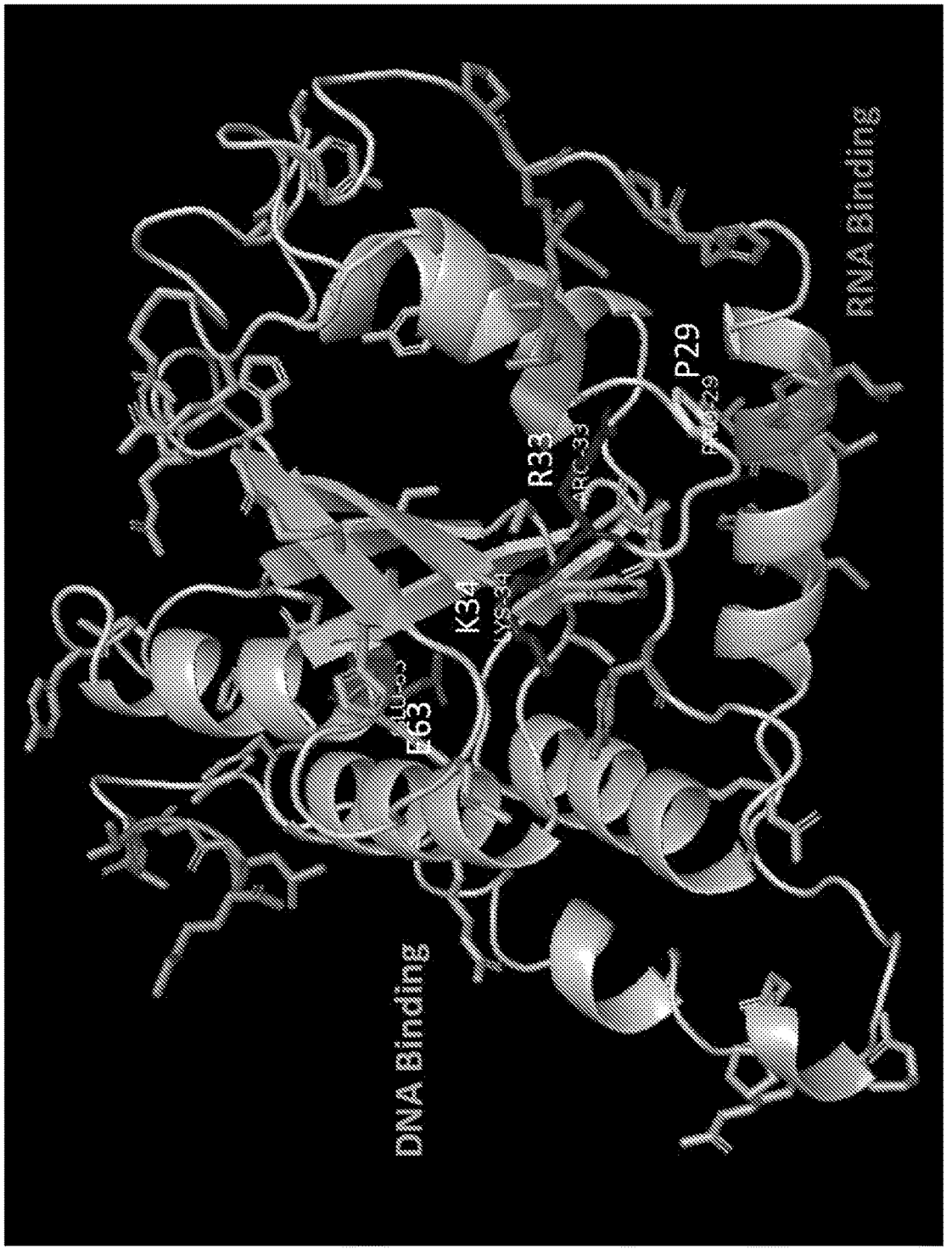
FIG. 10. Ribbon diagram of predicted structural model of rAPOBEC1. Image was generated using the PyMOL software with the model generated by the Phyre2 platform. Potential DNA and RNA binding amino acid residues were predicted using DRNApred and residues predicted to influence RNA binding are highlighted in the image.
Figure 11:
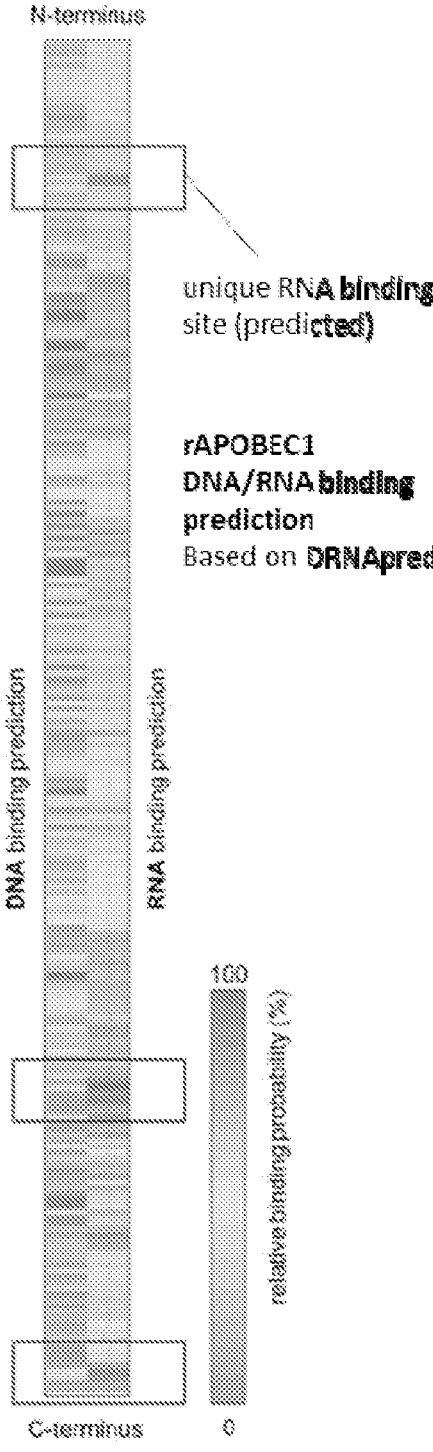
FIG. 11. Predicted residues in rAPOBEC1 for DNA and RNA binding. The heat map shows potential rAPOBEC1 DNA (left) and RNA (right) binding prediction based on the DRNApred binding prediction tool. Regions of the protein predicted to have RNA binding and not DNA binding activity are highlighted with red boxes. Greyscales highlight the relative binding probability in % for each respective type of nucleic acid. N- and C-termini of the rAPOBEC1 protein are noted.
Figure 12A:
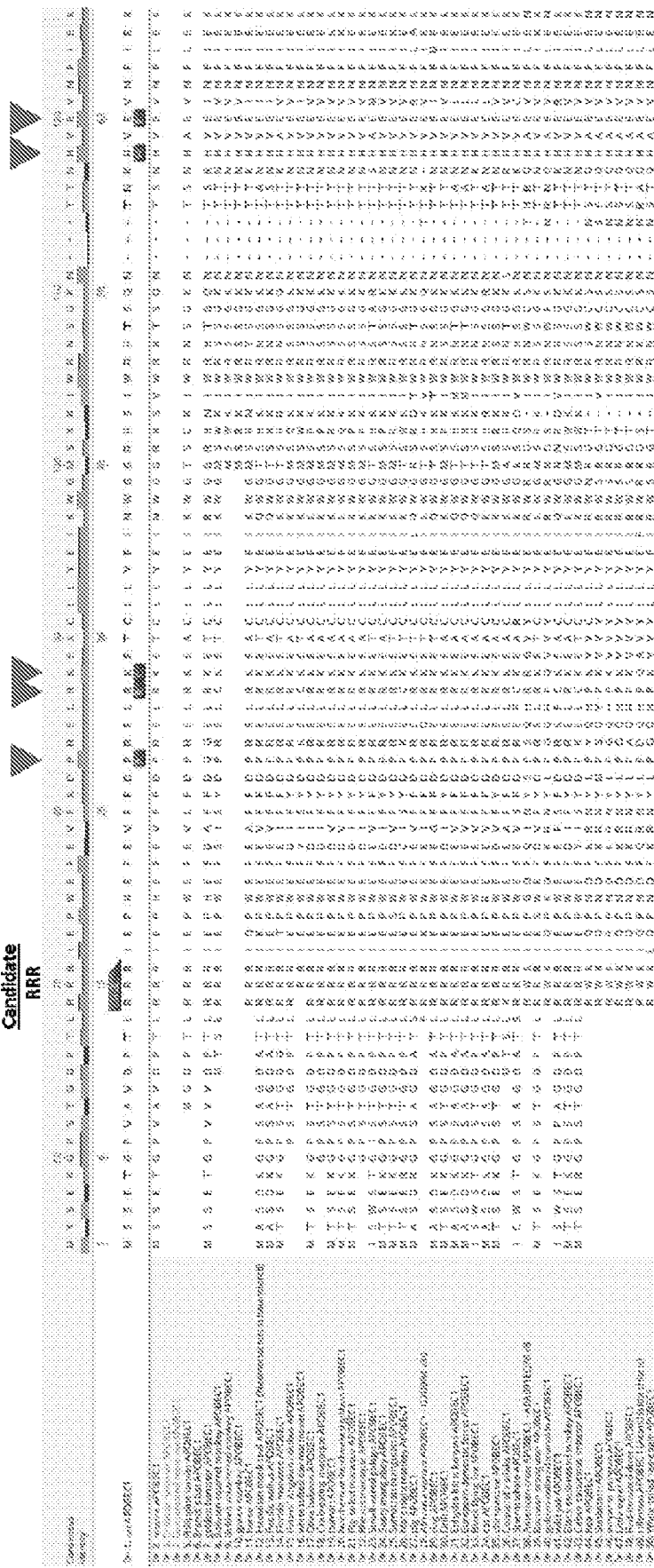
FIGS. 12A-12B. Alignment of APOBEC1 orthologues (N-terminal region). We aligned all APOBEC1 orthologues accessible on the uniprot platform to rAPOBEC1 amino acid sequence (12A, amino acids 1-50; 12B, amino acids 51-86). Arrowheads mark residues shown or predicted to reduce RNA editing or binding activities. Alignment was performed using Geneious7 software. This figure only depicts relevant N-terminal residues. Orthologues were ranked (numbers) by their similarity to rAPOBEC1. Each amino acid was ranked by its similarity across all species at the specific site (greyscale at each distribution, darker meaning higher conservation across species).
Figure 12B:
Figure 13A:
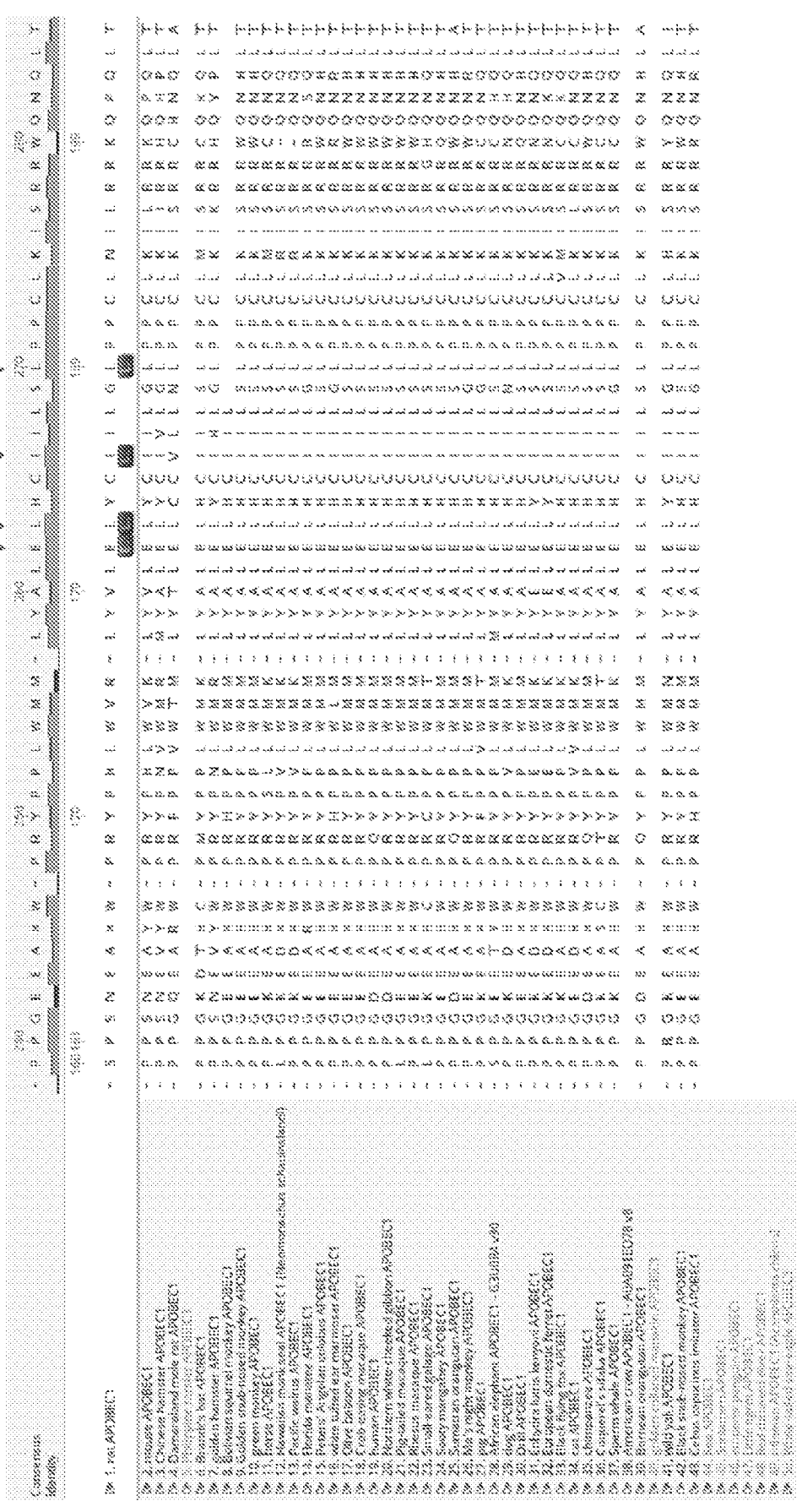

In addition to the SECURE base editor variants described and characterized above, we hypothesize that a number of additional APOBEC 1 mutations may on their own confer the desired differential RNA vs. DNA editing activities to base editors and/or may help to improve the activity profiles of the variants we have already tested. No structural information is currently available for APOBEC1. However, as described in Methods, we built a structural model of APOBEC1 using Phyre2 (Kelley L A et al. Nature Protocols 10, 845-858 2015; PMID 25950237) and then predicted DNA- and RNA-binding residues using the DRNApred web interface (Yan&Kurgan, N A R 2017; PMID 28132027) (FIGS. 10 and 11). A number of positions are predicted to be RNA binding and not DNA binding and these residues are highlighted in FIGS. 10 and 11 and detailed in Table 3. Mutation of these residues may on their own or in combination with the other mutations we have already identified lead to improved differential DNA and RNA editing by base editors. In addition, there are a number of additional mutations described in a previous publication[27] that might be predicted to lead to additional SECURE variants or to enhance existing SECURE variants (Table 3) and/or that may be useful for truncating the size of APOBEC1 and thus the size of the base editor fusion protein (Table 3).

TABLE 3

| Residue Change | Reasoning |
| --- | --- |
| E24, V25 | model & RNA binding prediction |
| R118, Y120, H121, R126 | model & RNA binding prediction |
| W224-K229 | model & RNA binding prediction |
| P168-I186 | model & RNA binding prediction |
| L173 + L180 | model & RNA binding prediction |
| R15, R16, R17, to K15-17 & A15-17 | Teng et al, J Lipid Research 1999 |
| Deletion E181-L210 | Teng et al, J Lipid Research 1999 |
| P190 + P191 | Teng et al, J Lipid Research 1999 |
| Deletion L210-K229 (C-terminal) | Teng et al, J Lipid Research 1999 |
| Deletion S2-L14 (N-terminal) | Teng et al, J Lipid Research 1999 |
| V64, F66 | Teng et al, J Lipid Research 1999 |
| L180A | Teng et al, J Lipid Research 1999 |
| C192, L193, L196, P201, L203, L210, P219, P220 | Teng et al, J Lipid Research 1999 |
| P92 | MacGinnitie et al, JBC 1995 |

Amino acid residues whose mutation may be expected to yield base editor SECURE variants. These positions were chosen based on an APOBEC1 structural model and RNA/DNA binding predictions or based on previous description in the literature as residues whose mutation reduced the RNA editing or binding activities of isolated APOBEC1.

Example 3. Assessing Impacts of Off-Target RNA Editing on Cell Viability

The observation of extensive RNA edits by both cytosine and adenine base editors has important implications for research and therapeutic applications of these technologies. Confounding effects of unwanted RNA editing will need to be accounted for in research studies, especially if stable base editor expression (even in the absence of a gRNA) is used. For human therapeutic applications, the duration and level of BE expression should be kept to the minimums needed. Our data suggest that safety assessments for human therapeutics may need to include an analysis of the potential functional consequences of transcriptome-wide RNA edits. The short timeframe of our transient transfection experiments did not permit us to assess the longer-term functional consequences of widespread RNA editing but initial in silico and experimental analyses we have performed suggest that some edits may have phenotypic impacts on cells (FIG. 16).

We transfected HEK293T cells in triplicate with plasmids expressing the RNF2 gRNA and either nCas9 UGI-NLS, wild-type BE3, BE3-R33A, BE3-R33A/K34A, and BE3-E63Q (each as 2A fusions to GFP). GFP-positive cells were sorted 36 hours post-transfection (all GFP-sorting, see Methods) and then equal numbers of viable sorted cells (as determined by acridine orange/propidium iodide staining) were plated into three technical replicate wells per biological replicate for four timepoints (Methods). At various timepoints post-plating (days 1, 2, 3, and 4), we performed a cell viability assay (CellTiter-Glo) for each biological replicate (n=3) in technical triplicates (Methods). In this assay, mean luminescence RLU values are an indirect measure of ATP content, which is directly proportional to the number of viable cells. The results of these experiments (FIG. 16) show a modest decrease in mean cell viability for wild-type BE3 relative to that of the nCas9 control at all four days (ranging from 68% to 80% RLU relative to nCas9-UGI-NLS, $p<0.001$ for days 2, 3 and 4-significant after multiple testing correction). By contrast, the mean cell viabilities of the BE3-R33A/K34A and the BE3-E63Q (catalytically inactive) variants are similar to or higher than that of the nCas9-UGI-NLS control (minimum RLU of 95% relative to nCas9-UGI, no significant decreases; FIG. 16). The BE3-R33A variant mean relative RLU value initially resembles that of wild-type BE3 (reduction to 76%) but then begins to resemble that of nCas9 by days 3 and 4 (reductions to 90% and 90%, nominally significant with $p<0.05$). (Additional details of the statistical test are described in Methods.) In sum, this experiment shows that wild-type BE3 induces a modest but statistically significant negative effect on cell viability when compared to nCas9-UGI-NLS whereas the two SECURE-BE3 variants show either a smaller negative effect (BE3-R33A) or no detectable effect (BE-R33A/K34A).

We note that there are several reasons why this experimental setup might detect only a modest effect of wild-type BE3 on cell viability: First, the negative impacts of transfection and FACS procedures on cell health are likely more substantial than that of the base editor. The effects of these experimental procedures are controlled for with the nCas9-UGI and the BE3-E63Q negative controls but it is likely that a large proportion of the dynamic range of the cell viability assay is lost due to the early toxicity induced by those two procedures. Second, because we are performing transient transfection, there will be a great deal of heterogeneity in the numbers, frequencies, and combinations of RNA edits induced in any given cell in the population. Hence, it may be challenging to observe any toxic effects due to this heterogeneity and an inducible, stable expression system will likely be better suited to detect cell viability effects. Finally, it is also possible that both pro- and anti-proliferative edits may exist in the same or different cells and this might therefore offset any anti-proliferative effects as well.

REFERENCES

1. Komor, A. C., Badran, A. H. & Liu, D. R. CRISPR-Based Technologies for the Manipulation of Eukaryotic Genomes. Cell 168, 20-36 (2017).

2. Komor, A. C., Kim, Y. B., Packer, M. S., Zuris, J. A. & Liu, D. R.
Programmable editing of a target base in genomic DNA without double-stranded DNA cleavage. Nature 533, 420-424 (2016).

3. Komor, A. C. et al. Improved base excision repair inhibition and bacteriophage Mu Gam protein yields C: G-to-T: A base editors with higher efficiency and product purity. Sci Adv 3, eaao4774 (2017).

4. Zong, Y. et al. Precise base editing in rice, wheat and maize with a Cas9-cytidine deaminase fusion. Nat Biotechnol 35, 438-440 (2017).

5. Rees, H. A. et al. Improving the DNA specificity and applicability of base editing through protein engineering and protein delivery. Nat Commun 8, 15790 (2017).

6. Zafra, M. P. et al. Optimized base editors enable efficient editing in cells, organoids and mice. Nat Biotechnol 36, 888-893 (2018).

7. Koblan, L. W. et al. Improving cytidine and adenine base editors by expression optimization and ancestral reconstruction. Nat Biotechnol 36, 843-846 (2018).

8. Chadwick, A. C., Evitt, N. H., Lv, W. & Musunuru, K. Reduced Blood Lipid Levels With In Vivo CRISPR-Cas9 Base Editing of ANGPTL3. Circulation 137, 975-977 (2018).

9. Yeh, W. H., Chiang, H., Rees, H. A., Edge, A. S. B. & Liu, D. R. In vivo base editing of post-mitotic sensory cells. Nat Commun 9, 2184 (2018).

10. Zhang, Y. et al. Programmable base editing of zebrafish genome using a modified CRISPR-Cas9 system. Nat Commun 8, 118 (2017).

11. Gehrke, J. M. et al. An APOBEC3A-Cas9 base editor with minimized bystander and off-target activities. Nat Biotechnol (2018).

12. Wang, X. et al. Efficient base editing in methylated regions with a human APOBEC3A-Cas9 fusion. Nat Biotechnol (2018).

13. Nishida, K. et al. Targeted nucleotide editing using hybrid prokaryotic and vertebrate adaptive immune systems. Science 353 (2016).

14. Hess, G. T. et al. Directed evolution using dCas9-targeted somatic hypermutation in mammalian cells. Nat Methods 13, 1036-1042 (2016).

15. Shimatani, Z. et al. Targeted base editing in rice and tomato using a CRISPR-Cas9 cytidine deaminase fusion. Nat Biotechnol 35, 441-443 (2017).

16. Chen, S. H. et al. Apolipoprotein B-48 is the product of a messenger RNA with an organ-specific in-frame stop codon. Science 238, 363-366 (1987).

17. Teng, B., Burant, C. F. & Davidson, N. O. Molecular cloning of an apolipoprotein B messenger RNA editing protein. Science 260, 1816-1819 (1993).

18. Sowden, M., Hamm, J. K. & Smith, H. C. Overexpression of APOBEC-1 results in mooring sequence-dependent promiscuous RNA editing. J Biol Chem 271, 3011-3017 (1996).

19. Yamanaka, S., Poksay, K. S., Driscoll, D. M. & Innerarity, T. L.
Hyperediting of multiple cytidines of apolipoprotein B mRNA by APOBEC-1 requires auxiliary protein(s) but not a mooring sequence motif. J Biol Chem 271, 11506-11510 (1996).

20. Skuse, G. R., Cappione, A. J., Sowden, M., Metheny, L. J. & Smith, H. C. The neurofibromatosis type I messenger RNA undergoes base-modification RNA editing. Nucleic Acids Res 24, 478-485 (1996).

21. Yamanaka, S., Poksay, K. S., Arnold, K. S. & Innerarity, T. L. A novel translational repressor mRNA is edited extensively in livers containing tumors caused by the transgene expression of the apoB mRNA-editing enzyme. Genes Dev 11, 321-333 (1997).

22. Rosenberg, B. R., Hamilton, C. E., Mwangi, M. M., Dewell, S. &
Papavasiliou, F. N. Transcriptome-wide sequencing reveals numerous APOBEC1 mRNA-editing targets in transcript 3' UTRs. Nat Struct Mol Biol 18, 230-236 (2011).

23. Blanc, V. et al. Genome-wide identification and functional analysis of Apobec-1-mediated C-to-U RNA editing in mouse small intestine and liver. Genome Biol 15, R79 (2014).

24. Salter, J. D., Bennett, R. P. & Smith, H. C. The APOBEC Protein Family: United by Structure, Divergent in Function. Trends Biochem Sci 41, 578-594 (2016).

25. Yamanaka, S., Poksay, K. S., Balestra, M. E., Zeng, G. Q. & Innerarity, T.L. Cloning and mutagenesis of the rabbit ApoB mRNA editing protein. A zinc motif is essential for catalytic activity, and noncatalytic auxiliary factor(s) of the editing complex are widely distributed. J Biol Chem 269, 21725-21734 (1994).

26. Navaratnam, N. et al. Evolutionary origins of apoB mRNA editing:
catalysis by a cytidine deaminase that has acquired a novel RNA-binding motif at its active site. Cell 81, 187-195 (1995).

27. Teng, B. B. et al. Mutational analysis of apolipoprotein B mRNA editing enzyme (APOBEC1). Structure-function relationships of RNA editing and dimerization. J Lipid Res 40, 623-635 (1999).

28. Chen, Z. et al. Hypermutation induced by APOBEC-1 overexpression can be eliminated. RNA 16, 1040-1052 (2010).

29. Chester, A. et al. The apolipoprotein B mRNA editing complex performs a multifunctional cycle and suppresses nonsense-mediated decay. EMBO J 22, 3971-3982 (2003).

EXEMPLARY SEQUENCES
BE1 for Mammalian expression (rAPOBEC1-XTEN-dCas9-NLS)

SEQ ID: 116

MSSETGPVAVDPTLRRRIEPHEFEVFFDPRELRKETCLLYEINWGGR

HSIWRHTSQNTNKHVEVNFIEKFTTERYFCPNTRCSITWFLSWSPCG

ECSRAITEFLSRYPHVTLFIYIARLYHHADPRNRQGLRDLISSGVTI

QIMTEQESGYCWRNFVNYSPSNEAHWPRYPHLWVRLYVLELYCIILG

LPPCLNILRRKQPQLTFFTIALQSCHYQRLPPHILWATGLKSGSETP

GTSESATPESDKKYSIGLAIGTNSVGWAVITDEYKVPSKKFKVLGNT

DRHSIKKNLIGALLFDSGETAEATRLKRTARRRYTRRKNRICYLQEI

FSNEMAKVDDSFFHRLEESFLVEEDKKHERHPIFGNIVDEVAYHEKY

PTIYHLRKKLVDSTDKADLRLIYLALAHMIKFRGHFLIEGDLNPDNS

DVDKLFIQLVQTYNQLFEENPINASGVDAKAILSARLSKSRRLENLI

AQLPGEKKNGLFGNLIALSLGLTPNFKSNFDLAEDAKLQLSKDTYDD

-continued

DLDNLLAQIGDQYADLFLAAKNLSDAILLSDILRVNTEITKAPLSAS

MIKRYDEHHQDLTLLKALVRQQLPEKYKEIFFDQSKNGYAGYIDGGA

SQEEFYKFIKPILEKMDGTEELLVKLNREDLLRKQRTFDNGSIPHQI

HLGELHAILRRQEDFYPFLKDNREKIEKILTFRIPYYVGPLARGNSR

FAWMTRKSEETITPWNFEEVVDKGASAQSFIERMTNFDKNLPNEKVL

PKHSLLYEYFTVYNELTKVKYVTEGMRKPAFLSGEQKKAIVDLLFKT

NRKVTVKQLKEDYFKKIECFDSVEISGVEDRFNASLGTYHDLLKIIK

DKDFLDNEENEDILEDIVLTLTLFEDREMIEERLKTYAHLFDDKVMK

QLKRRRYTGWGRLSRKLINGIRDKQSGKTILDFLKSDGFANRNFMQL

IHDDSLTFKEDIQKAQVSGQGDSLHEHIANLAGSPAIKKGILQTVKV

VDELVKVMGRHKPENIVIEMARENQTTQKGQKNSRERMKRIEEGIKE

LGSQILKEHPVENTQLQNEKLYLYYLQNGRDMYVDQELDINRLSDYD

VDAIVPQSFLKDDSIDNKVLTRSDKNRGKSDNVPSEEVVKKMKNYWR

QLLNAKLITQRKFDNLTKAERGGLSELDKAGFIKRQLVETRQITKHV

AQILDSRMNTKYDENDKLIREVKVITLKSKLVSDFRKDFQFYKVREI

NNYHHAHDAYLNAVVGTALIKKYPKLESEFVYGDYKVYDVRKMIAKS

EQEIGKATAKYFFYSNIMNFFKTEITLANGEIRKRPLIETNGETGEI

VWDKGRDFATVRKVLSMPQVNIVKKTEVQTGGFSKESILPKRNSDKL

IARKKDWDPKKYGGFDSPTVAYSVLVVAKVEKGKSKKLKSVKELLGI

TIMERSSFEKNPIDFLEAKGYKEVKKDLIIKLPKYSLFELENGRKRM

LASAGELQKGNELALPSKYVNFLYLASHYEKLKGSPEDNEQKQLFVE

QHKHYLDEIIEQISEFSKRVILADANLDKVLSAYNKHRDKPIREQAE

NIIHLFTLTNLGAPAAFKYFDTTIDRKRYTSTKEVLDATLIHQSITG

LYETRIDLSQLGGDSGGSPKKKRKV

BE2 (rAPOBEC1-XTEN-dCas9-UGI-NLS)

SEQ ID: 117

MSSETGPVAVDPTLRRRIEPHEFEVFFDPRELRKETCLLYEINWGGR

HSIWRHTSQNTNKHVEVNFIEKFTTERYFCPNTRCSITWFLSWSPCG

ECSRAITEFLSRYPHVTLFIYIARLYHHADPRNRQGLRDLISSGVTI

QIMTEQESGYCWRNFVNYSPSNEAHWPRYPHLWVRLYVLELYCIILG

LPPCLNILRRKQPQLTFFTIALQSCHYQRLPPHILWATGLKSGSETP

GTSESATPESDKKYSIGLAIGTNSVGWAVITDEYKVPSKKFKVLGNT

DRHSIKKNLIGALLFDSGETAEATRLKRTARRRYTRRKNRICYLQEI

FSNEMAKVDDSFFHRLEESFLVEEDKKHERHPIFGNIVDEVAYHEKY

PTIYHLRKKLVDSTDKADLRLIYLALAHMIKFRGHFLIEGDLNPDNS

DVDKLFIQLVQTYNQLFEENPINASGVDAKAILSARLSKSRRLENLI

AQLPGEKKNGLFGNLIALSLGLTPNFKSNFDLAEDAKLQLSKDTYDD

DLDNLLAQIGDQYADLFLAAKNLSDAILLSDILRVNTEITKAPLSAS

MIKRYDEHHQDLTLLKALVRQQLPEKYKEIFFDQSKNGYAGYIDGGA

SQEEFYKFIKPILEKMDGTEELLVKLNREDLLRKQRTFDNGSIPHQI

HLGELHAILRRQEDFYPFLKDNREKIEKILTFRIPYYVGPLARGNSR

FAWMTRKSEETITPWNFEEVVDKGASAQSFIERMTNFDKNLPNEKVL

-continued

PKHSLLYEYFTVYNELTKVKYVTEGMRKPAFLSGEQKKAIVDLLFKT

NRKVTVKQLKEDYFKKIECFDSVEISGVEDRFNASLGTYHDLLKIIK

DKDFLDNEENEDILEDIVLTLTLFEDREMIEERLKTYAHLFDDKVMK

QLKRRRYTGWGRLSRKLINGIRDKQSGKTILDFLKSDGFANRNFMQL

IHDDSLTFKEDIQKAQVSGQGDSLHEHIANLAGSPAIKKGILQTVKV

VDELVKVMGRHKPENIVIEMARENQTTQKGQKNSRERMKRIEEGIKE

LGSQILKEHPVENTQLQNEKLYLYYLQNGRDMYVDQELDINRLSDYD

VDAIVPQSFLKDDSIDNKVLTRSDKNRGKSDNVPSEEVVKKMKNYWR

QLLNAKLITQRKFDNLTKAERGGLSELDKAGFIKRQLVETRQITKHV

AQILDSRMNTKYDENDKLIREVKVITLKSKLVSDFRKDFQFYKVREI

NNYHHAHDAYLNAVVGTALIKKYPKLESEFVYGDYKVYDVRKMIAKS

EQEIGKATAKYFFYSNIMNFFKTEITLANGEIRKRPLIETNGETGEI

VWDKGRDFATVRKVLSMPQVNIVKKTEVQTGGFSKESILPKRNSDKL

IARKKDWDPKKYGGFDSPTVAYSVLVVAKVEKGKSKKLKSVKELLGI

TIMERSSFEKNPIDFLEAKGYKEVKKDLIIKLPKYSLFELENGRKRM

LASAGELQKGNELALPSKYVNFLYLASHYEKLKGSPEDNEQKQLFVE

QHKHYLDEIIEQISEFSKRVILADANLDKVLSAYNKHRDKPIREQAE

NIIHLFTLTNLGAPAAFKYFDTTIDRKRYTSTKEVLDATLIHQSITG

LYETRIDLSQLGGDSGGSTNLSDIIEKETGKQLVIQESILMLPEEVE

EVIGNKPESDILVHTAYDESTDENVMLLTSDAPEYKPWALVIQDSNG

ENKIKMLSGGSPKKKRKV

BE3 (rAPOBEC1-XTEN-Cas9n-UGI-NLS)

SEQ ID: 118

MSSETGPVAVDPTLRRRIEPHEFEVFFDPRELRKETCLLYEINWGGR

HSIWRHTSQNTNKHVEVNFIEKFTTERYFCPNTRCSITWFLSWSPCG

ECSRAITEFLSRYPHVTLFIYIARLYHHADPRNRQGLRDLISSGVTI

QIMTEQESGYCWRNFVNYSPSNEAHWPRYPHLWVRLYVLELYCIILG

LPPCLNILRRKQPQLTFFTIALQSCHYQRLPPHILWATGLKSGSETP

GTSESATPESDKKYSIGLAIGTNSVGWAVITDEYKVPSKKFKVLGNT

DRHSIKKNLIGALLFDSGETAEATRLKRTARRRYTRRKNRICYLQEI

FSNEMAKVDDSFFHRLEESFLVEEDKKHERHPIFGNIVDEVAYHEKY

PTIYHLRKKLVDSTDKADLRLIYLALAHMIKFRGHFLIEGDLNPDNS

DVDKLFIQLVQTYNQLFEENPINASGVDAKAILSARLSKSRRLENLI

AQLPGEKKNGLFGNLIALSLGLTPNFKSNFDLAEDAKLQLSKDTYDD

DLDNLLAQIGDQYADLFLAAKNLSDAILLSDILRVNTEITKAPLSAS

MIKRYDEHHQDLTLLKALVRQQLPEKYKEIFFDQSKNGYAGYIDGGA

SQEEFYKFIKPILEKMDGTEELLVKLNREDLLRKQRTFDNGSIPHQI

HLGELHAILRRQEDFYPFLKDNREKIEKILTFRIPYYVGPLARGNSR

FAWMTRKSEETITPWNFEEVVDKGASAQSFIERMTNFDKNLPNEKVL

PKHSLLYEYFTVYNELTKVKYVTEGMRKPAFLSGEQKKAIVDLLFKT

NRKVTVKQLKEDYFKKIECFDSVEISGVEDRFNASLGTYHDLLKIIK

-continued

DKDFLDNEENEDILEDIVLTLTLFEDREMIEERLKTYAHLFDDKVMK

QLKRRRYTGWGRLSRKLINGIRDKQSGKTILDFLKSDGFANRNFMQL

IHDDSLTFKEDIQKAQVSGQGDSLHEHIANLAGSPAIKKGILQTVKV

VDELVKVMGRHKPENIVIEMARENQTTQKGQKNSRERMKRIEEGIKE

LGSQILKEHPVENTQLQNEKLYLYYLQNGRDMYVDQELDINRLSDYD

VDHIVPQSFLKDDSIDNKVLTRSDKNRGKSDNVPSEEVVKKMKNYWR

QLLNAKLITQRKFDNLTKAERGGLSELDKAGFIKRQLVETRQITKHV

AQILDSRMNTKYDENDKLIREVKVITLKSKLVSDFRKDFQFYKVREI

NNYHHAHDAYLNAVVGTALIKKYPKLESEFVYGDYKVYDVRKMIAKS

EQEIGKATAKYFFYSNIMNFFKTEITLANGEIRKRPLIETNGETGEI

VWDKGRDFATVRKVLSMPQVNIVKKTEVQTGGFSKESILPKRNSDKL

IARKKDWDPKKYGGFDSPTVAYSVLVVAKVEKGKSKKLKSVKELLGI

TIMERSSFEKNPIDFLEAKGYKEVKKDLIIKLPKYSLFELENGRKRM

LASAGELQKGNELALPSKYVNFLYLASHYEKLKGSPEDNEQKQLFVE

QHKHYLDEIIEQISEFSKRVILADANLDKVLSAYNKHRDKPIREQAE

NIIHLFTLTNLGAPAAFKYFDTTIDRKRYTSTKEVLDATLIHQSITG

LYETRIDLSQLGGDSGGSTNLSDIIEKETGKQLVIQESILMLPEEVE

EVIGNKPESDILVHTAYDESTDENVMLLTSDAPEYKPWALVIQDSNG

ENKIKMLSGGSPKKKRKV

CDA1-BE3:
                                              SEQ ID: 119
MTDAEYVRIHEKLDIYTFKKQFFNNKKSVSHRCYVLFELKRRGERRA

CFWGYAVNKPQSGTERGIHAEIFSIRKVEEYLRDNPGQFTINWYSSW

SPCADCAEKILEWYNQELRGNGHTLKIWACKLYYEKNARNQIGLWNL

RDNGVGLNVMVSEHYQCCRKIFIQSSHNQLNENRWLEKTLKRAEKRR

SELSIMIQVKILHTTKSPAVSGSETPGTSESATPESDKKYSIGLAIG

TNSVGWAVITDEYKVPSKKFKVLGNTDRHSIKKNLIGALLFDSGETA

EATRLKRTARRRYTRRKNRICYLQEIFSNEMAKVDDSFFHRLEESFL

VEEDKKHERHPIFGNIVDEVAYHEKYPTIYHLRKKLVDSTDKADLRL

IYLALAHMIKFRGHFLIEGDLNPDNSDVDKLFIQLVQTYNQLFEENP

INASGVDAKAILSARLSKSRRLENLIAQLPGEKKNGLFGNLIALSLG

LTPNFKSNFDLAEDAKLQLSKDTYDDDLDNLLAQIGDQYADLFLAAK

NLSDAILLSDILRVNTEITKAPLSASMIKRYDEHHQDLTLLKALVRQ

QLPEKYKEIFFDQSKNGYAGYIDGGASQEEFYKFIKPILEKMDGTEE

LLVKLNREDLLRKQRTFDNGSIPHQIHLGELHAILRRQEDFYPFLKD

NREKIEKILTFRIPYYVGPLARGNSRFAWMTRKSEETITPWNFEEVV

DKGASAQSFIERMTNFDKNLPNEKVLPKHSLLYEYFTVYNELTKVKY

VTEGMRKPAFLSGEQKKAIVDLLFKTNRKVTVKQLKEDYFKKIECFD

SVEISGVEDRFNASLGTYHDLLKIIKDKDFLDNEENEDILEDIVLTL

TLFEDREMIEERLKTYAHLFDDKVMKQLKRRRYTGWGRLSRKLINGI

RDKQSGKTILDFLKSDGFANRNFMQLIHDDSLTFKEDIQKAQVSGQG

DSLHEHIANLAGSPAIKKGILQTVKVVDELVKVMGRHKPENIVIEMA

-continued

RENQTTQKGQKNSRERMKRIEEGIKELGSQILKEHPVENTQLQNEKL

YLYYLQNGRDMYVDQELDINRLSDYDVDHIVPQSFLKDDSIDNKVLT

RSDKNRGKSDNVPSEEVVKKMKNYWRQLLNAKLITQRKFDNLTKAER

GGLSELDKAGFIKRQLVETRQITKHVAQILDSRMNTKYDENDKLIRE

VKVITLKSKLVSDFRKDFQFYKVREINNYHHAHDAYLNAVVGTALIK

KYPKLESEFVYGDYKVYDVRKMIAKSEQEIGKATAKYFFYSNIMNFF

KTEITLANGEIRKRPLIETNGETGEIVWDKGRDFATVRKVLSMPQVN

IVKKTEVQTGGFSKESILPKRNSDKLIARKKDWDPKKYGGFDSPTVA

YSVLVVAKVEKGKSKKLKSVKELLGITIMERSSFEKNPIDFLEAKGY

KEVKKDLIIKLPKYSLFELENGRKRMLASAGELQKGNELALPSKYVN

FLYLASHYEKLKGSPEDNEQKQLFVEQHKHYLDEIIEQISEFSKRVI

LADANLDKVLSAYNKHRDKPIREQAENIIHLFTLTNLGAPAAFKYFD

TTIDRKRYTSTKEVLDATLIHQSITGLYETRIDLSQLGGDSGGSTNL

SDIIEKETGKQLVIQESILMLPEEVEEVIGNKPESDILVHTAYDEST

DENVMLLTSDAPEYKPWALVIQDSNGENKIKMLSGGSPKKKRKV

AID-BE3:
                                              SEQ ID: 120
MDSLLMNRRKFLYQFKNVRWAKGRRETYLCYVVKRRDSATSFSLDFG

YLRNKNGCHVELLFLRYISDWDLDPGRCYRVTWFTSWSPCYDCARHV

ADFLRGNPNLSLRIFTARLYFCEDRKAEPEGLRRLHRAGVQIAIMTF

KDYFYCWNTFVENHERTFKAWEGLHENSVRLSRQLRRILLPLYEVDD

LRDAFRTLGLSGSETPGTSESATPESDKKYSIGLAIGTNSVGWAVIT

DEYKVPSKKFKVLGNTDRHSIKKNLIGALLFDSGETAEATRLKRTAR

RRYTRRKNRICYLQEIFSNEMAKVDDSFFHRLEESFLVEEDKKHERH

PIFGNIVDEVAYHEKYPTIYHLRKKLVDSTDKADLRLIYLALAHMIK

FRGHFLIEGDLNPDNSDVDKLFIQLVQTYNQLFEENPINASGVDAKA

ILSARLSKSRRLENLIAQLPGEKKNGLFGNLIALSLGLTPNFKSNFD

LAEDAKLQLSKDTYDDDLDNLLAQIGDQYADLFLAAKNLSDAILLSD

ILRVNTEITKAPLSASMIKRYDEHHQDLTLLKALVRQQLPEKYKEIF

FDQSKNGYAGYIDGGASQEEFYKFIKPILEKMDGTEELLVKLNREDL

LRKQRTFDNGSIPHQIHLGELHAILRRQEDFYPFLKDNREKIEKILT

FRIPYYVGPLARGNSRFAWMTRKSEETITPWNFEEVVDKGASAQSFI

ERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDR

FNASLGTYHDLLKIIKDKDFLDNEENEDILEDIVLTLTLFEDREMIE

ERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANL

AGSPAIKKGILQTVKVVDELVKVMGRHKPENIVIEMARENQTTQKGQ

KNSRERMKRIEEGIKELGSQILKEHPVENTQLQNEKLYLYYLQNGRD

MYVDQELDINRLSDYDVDHIVPQSFLKDDSIDNKVLTRSDKNRGKSD

NVPSEEVVKKMKNYWRQLLNAKLITQRKFDNLTKAERGGLSELDKAG

-continued

```
FIKRQLVETRQITKHVAQILDSRMNTKYDENDKLIREVKVITLKSKL

VSDFRKDFQFYKVREINNYHHAHDAYLNAVVGTALIKKYPKLESEFV

YGDYKVYDVRKMIAKSEQEIGKATAKYFFYSNIMNFFKTEITLANGE

IRKRPLIETNGETGEIVWDKGRDFATVRKVLSMPQVNIVKKTEVQTG

GFSKESILPKRNSDKLIARKKDWDPKKYGGFDSPTVAYSVLVVAKVE

KGKSKKLKSVKELLGITIMERSSFEKNPIDFLEAKGYKEVKKDLIIK

LPKYSLFELENGRKRMLASAGELQKGNELALPSKYVNFLYLASHYEK

LKGSPEDNEQKQLFVEQHKHYLDEIIEQISEFSKRVILADANLDKVL

SAYNKHRDKPIREQAENIIHLFTLTNLGAPAAFKYFDTTIDRKRYTS

TKEVLDATLIHQSITGLYETRIDLSQLGGDSGGSTNLSDIIEKETGK

QLVIQESILMLPEEVEEVIGNKPESDILVHTAYDESTDENVMLLTSD

APEYKPWALVIQDSNGENKIKMLSGGSPKKKRKV
```

BE3-Gam:

SEQ ID: 121
```
MAKPAKRIKSAAAAYVPQNRDAVITDIKRIGDLQREASRLETEMNDA

IAEITEKFAARIAPIKTDIETLSKGVQGWCEANRDELTNGGKVKTAN

LVTGDVSWRVRPPSVSIRGMDAVMETLERLGLQRFIRTKQEINKEAI

LLEPKAVAGVAGITVKSGIEDFSIIPFEQEAGISGSETPGTSESATP

ESSSETGPVAVDPTLRRRIEPHEFEVFFDPRELRKETCLLYEINWGG

RHSIWRHTSQNTNKHVEVNFIEKFTTERYFCPNTRCSITWFLSWSPC

GECSRAITEFLSRYPHVTLFIYIARLYHHADPRNRQGLRDLISSGVT

IQIMTEQESGYCWRNFVNYSPSNEAHWPRYPHLWVRLYVLELYCIIL

GLPPCLNILRRKQPQLTFFTIALQSCHYQRLPPHILWATGLKSGSET

PGTSESATPESDKKYSIGLAIGTNSVGWAVITDEYKVPSKKFKVLGN

TDRHSIKKNLIGALLFDSGETAEATRLKRTARRRYTRRKNRICYLQE

IFSNEMAKVDDSFFHRLEESFLVEEDKKHERHPIFGNIVDEVAYHEK

YPTIYHLRKKLVDSTDKADLRLIYLALAHMIKFRGHFLIEGDLNPDN

SDVDKLFIQLVQTYNQLFEENPINASGVDAKAILSARLSKSRRLENL

IAQLPGEKKNGLFGNLIALSLGLTPNFKSNFDLAEDAKLQLSKDTYD

DDLDNLLAQIGDQYADLFLAAKNLSDAILLSDILRVNTEITKAPLSA

SMIKRYDEHHQDLTLLKALVRQQLPEKYKEIFFDQSKNGYAGYIDGG

ASQEEFYKFIKPILEKMDGTEELLVKLNREDLLRKQRTFDNGSIPHQ

IHLGELHAILRRQEDFYPFLKDNREKIEKILTFRIPYYVGPLARGNS

RFAWMTRKSEETITPWNFEEVVDKGASAQSFIERMTNFDKNLPNEKV

LPKHSLLYEYFTVYNELTKVKYVTEGMRKPAFLSGEQKKAIVDLLFK

TNRKVTVKQLKEDYFKKIECFDSVEISGVEDRFNASLGTYHDLLKII

KDKDFLDNEENEDILEDIVLTLTLFEDREMIEERLKTYAHLFDDKVM

KQLKRRRYTGWGRLSRKLINGIRDKQSGKTILDFLKSDGFANRNFMQ

LIHDDSLTFKEDIQKAQVSGQGDSLHEHIANLAGSPAIKKGILQTVK

VVDELVKVMGRHKPENIVIEMARENQTTQKGQKNSRERMKRIEEGIK

ELGSQILKEHPVENTQLQNEKLYLYYLQNGRDMYVDQELDINRLSDY

DVDHIVPQSFLKDDSIDNKVLTRSDKNRGKSDNVPSEEVVKKMKNYW
```

-continued

```
RQLLNAKLITQRKFDNLTKAERGGLSELDKAGFIKRQLVETRQITKH

VAQILDSRMNTKYDENDKLIREVKVITLKSKLVSDFRKDFQFYKVRE

INNYHHAHDAYLNAVVGTALIKKYPKLESEFVYGDYKVYDVRKMIAK

SEQEIGKATAKYFFYSNIMNFFKTEITLANGEIRKRPLIETNGETGE

IVWDKGRDFATVRKVLSMPQVNIVKKTEVQTGGFSKESILPKRNSDK

LIARKKDWDPKKYGGFDSPTVAYSVLVVAKVEKGKSKKLKSVKELLG

ITIMERSSFEKNPIDFLEAKGYKEVKKDLIIKLPKYSLFELENGRKR

MLASAGELQKGNELALPSKYVNFLYLASHYEKLKGSPEDNEQKQLFV

EQHKHYLDEIIEQISEFSKRVILADANLDKVLSAYNKHRDKPIREQA

ENIIHLFTLTNLGAPAAFKYFDTTIDRKRYTSTKEVLDATLIHQSIT

GLYETRIDLSQLGGDSGGSTNLSDIIEKETGKQLVIQESILMLPEEV

EEVIGNKPESDILVHTAYDESTDENVMLLTSDAPEYKPWALVIQDSN

GENKIKMLSGGSPKKKRKV
```

SaBE3-Gam:

SEQ ID: 122
```
MAKPAKRIKSAAAAYVPQNRDAVITDIKRIGDLQREASRLETEMNDA

IAEITEKFAARIAPIKTDIETLSKGVQGWCEANRDELTNGGKVKTAN

LVTGDVSWRVRPPSVSIRGMDAVMETLERLGLQRFIRTKQEINKEAI

LLEPKAVAGVAGITVKSGIEDFSIIPFEQEAGISGSETPGTSESATP

ESSSETGPVAVDPTLRRRIEPHEFEVFFDPRELRKETCLLYEINWGG

RHSIWRHTSQNTNKHVEVNFIEKFTTERYFCPNTRCSITWFLSWSPC

GECSRAITEFLSRYPHVTLFIYIARLYHHADPRNRQGLRDLISSGVT

IQIMTEQESGYCWRNFVNYSPSNEAHWPRYPHLWVRLYVLELYCIIL

GLPPCLNILRRKQPQLTFFTIALQSCHYQRLPPHILWATGLKSGSET

PGTSESATPESGKRNYILGLAIGITSVGYGIIDYETRDVIDAGVRLF

KEANVENNEGRRSKRGARRLKRRRRHRIQRVKKLLFDYNLLTDHSEL

SGINPYEARVKGLSQKLSEEEFSAALLHLAKRRGVHNVNEVEEDTGN

ELSTKEQISRNSKALEEKYVAELQLERLKKDGEVRGSINRFKTSDYV

KEAKQLLKVQKAYHQLDQSFIDTYIDLLETRRTYYEGPGEGSPFGWK

DIKEWYEMLMGHCTYFPEELRSVKYAYNADLYNALNDLNNLVITRDE

NEKLEYYEKFQIIENVFKQKKKPTLKQIAKEILVNEEDIKGYRVTST

GKPEFTNLKVYHDIKDITARKEIIENAELLDQIAKILTIYQSSEDIQ

EELTNLNSELTQEEIEQISNLKGYTGTHNLSLKAINLILDELWHTND

NQIAIFNRLKLVPKKVDLSQQKEIPTTLVDDFILSPVVKRSFIQSIK

VINAIIKKYGLPNDIIIELAREKNSKDAQKMINEMQKRNRQTNERIE

EIIRTTGKENAKYLIEKIKLHDMQEGKCLYSLEAIPLEDLLNNPFNY

EVDHIIPRSVSFDNSFNNKVLVKQEENSKKGNRTPFQYLSSSDSKIS

YETFKKHILNLAKGKGRISKTKKEYLLEERDINRFSVQKDFINRNLV

DTRYATRGLMNLLRSYFRVNNLDVKVKSINGGFTSFLRRKWKFKKER

NKGYKHHAEDALIIANADFIFKEWKKLDKAKKVMENQMFEEKQAESM

PEIETEQEYKEIFITPHQIKHIKDFKDYKYSHRVDKKPNRELINDTL
```

-continued

YSTRKDDKGNTLIVNNLNGLYDKDNDKLKKLINKSPEKLLMYHHDPQ

TYQKLKLIMEQYGDEKNPLYKYYEETGNYLTKYSKKDNGPVIKKIKY

YGNKLNAHLDITDDYPNSRNKVVKLSLKPYRFDVYLDNGVYKFVTVK

NLDVIKKENYYEVNSKCYEEAKKLKKISNQAEFIASFYNNDLIKING

ELYRVIGVNNDLLNRIEVNMIDITYREYLENMNDKRPPRIIKTIASK

TQSIKKYSTDILGNLYEVKSKKHPQIIKKGGSPKKKRKVSSDYKDHD

GDYKDHDIDYKDDDDKSGGSTNLSDIIEKETGKQLVIQESILMLPEE

VEEVIGNKPESDILVHTAYDESTDENVMLLTSDAPEYKPWALVIQDS

NGENKIKMLSGGSPKKKRKV

BE4:

SEQ ID: 123

MSSETGPVAVDPTLRRRIEPHEFEVFFDPRELRKETCLLYEINWGGR

HSIWRHTSQNTNKHVEVNFIEKFTTERYFCPNTRCSITWFLSWSPCG

ECSRAITEFLSRYPHVTLFIYIARLYHHADPRNRQGLRDLISSGVTI

QIMTEQESGYCWRNFVNYSPSNEAHWPRYPHLWVRLYVLELYCIILG

LPPCLNILRRKQPQLTFFTIALQSCHYQRLPPHILWATGLKSGGSSG

GSSGSETPGTSESATPESSGGSSGGSDKKYSIGLAIGTNSVGWAVIT

DEYKVPSKKFKVLGNTDRHSIKKNLIGALLFDSGETAEATRLKRTAR

RRYTRRKNRICYLQEIFSNEMAKVDDSFFHRLEESFLVEEDKKHERH

PIFGNIVDEVAYHEKYPTIYHLRKKLVDSTDKADLRLIYLALAHMIK

FRGHFLIEGDLNPDNSDVDKLFIQLVQTYNQLFEENPINASGVDAKA

ILSARLSKSRRLENLIAQLPGEKKNGLFGNLIALSLGLTPNFKSNFD

LAEDAKLQLSKDTYDDDLDNLLAQIGDQYADLFLAAKNLSDAILLSD

ILRVNTEITKAPLSASMIKRYDEHHQDLTLLKALVRQQLPEKYKEIF

FDQSKNGYAGYIDGGASQEEFYKFIKPILEKMDGTEELLVKLNREDL

LRKQRTFDNGSIPHQIHLGELHAILRRQEDFYPFLKDNREKIEKILT

FRIPYYVGPLARGNSRFAWMTRKSEETITPWNFEEVVDKGASAQSFI

ERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDR

FNASLGTYHDLLKIIKDKDFLDNEENEDILEDIVLTLTLFEDREMIE

ERLKTYAHLFDDKVMKQLKRRRYTGWGRLSRKLINGIRDKQSGKTIL

DFLKSDGFANRNFMQLIHDDSLTFKEDIQKAQVSGQGDSLHEHIANL

AGSPAIKKGILQTVKVVDELVKVMGRHKPENIVIEMARENQTTQKGQ

KNSRERMKRIEEGIKELGSQILKEHPVENTQLQNEKLYLYYLQNGRD

MYVDQELDINRLSDYDVDHIVPQSFLKDDSIDNKVLTRSDKNRGKSD

NVPSEEVVKKMKNYWRQLLNAKLITQRKFDNLTKAERGGLSELDKAG

FIKRQLVETRQITKHVAQILDSRMNTKYDENDKLIREVKVITLKSKL

VSDFRKDFQFYKVREINNYHHAHDAYLNAVVGTALIKKYPKLESEFV

YGDYKVYDVRKMIAKSEQEIGKATAKYFFYSNIMNFFKTEITLANGE

IRKRPLIETNGETGEIVWDKGRDFATVRKVLSMPQVNIVKKTEVQTG

GFSKESILPKRNSDKLIARKKDWDPKKYGGFDSPTVAYSVLVVAKVE

KGKSKKLKSVKELLGITIMERSSFEKNPIDFLEAKGYKEVKKDLIIK

-continued

LPKYSLFELENGRKRMLASAGELQKGNELALPSKYVNFLYLASHYEK

LKGSPEDNEQKQLFVEQHKHYLDEIIEQISEFSKRVILADANLDKVL

SAYNKHRDKPIREQAENIIHLFTLTNLGAPAAFKYFDTTIDRKRYTS

TKEVLDATLIHQSITGLYETRIDLSQLGGDSGGSGGSGGSTNLSDII

EKETGKQLVIQESILMLPEEVEEVIGNKPESDILVHTAYDESTDENV

MLLTSDAPEYKPWALVIQDSNGENKIKMLSGGSGGSGGSTNLSDIIE

KETGKQLVIQESILMLPEEVEEVIGNKPESDILVHTAYDESTDENVM

LLTSDAPEYKPWALVIQDSNGENKIKMLSGGSPKKKRK

BE4-Gam:

SEQ ID: 124

MAKPAKRIKSAAAAYVPQNRDAVITDIKRIGDLQREASRLETEMNDA

IAEITEKFAARIAPIKTDIETLSKGVQGWCEANRDELTNGGKVKTAN

LVTGDVSWRVRPPSVSIRGMDAVMETLERLGLQRFIRTKQEINKEAI

LLEPKAVAGVAGITVKSGIEDFSIIPFEQEAGISGSETPGTSESATP

ESSSETGPVAVDPTLRRRIEPHEFEVFFDPRELRKETCLLYEINWGG

RHSIWRHTSQNTNKHVEVNFIEKFTTERYFCPNTRCSITWFLSWSPC

GECSRAITEFLSRYPHVTLFIYIARLYHHADPRNRQGLRDLISSGVT

IQIMTEQESGYCWRNFVNYSPSNEAHWPRYPHLWVRLYVLELYCIIL

GLPPCLNILRRKQPQLTFFTIALQSCHYQRLPPHILWATGLKSGGSS

GGSSGSETPGTSESATPESSGGSSGGSDKKYSIGLAIGTNSVGWAVI

TDEYKVPSKKFKVLGNTDRHSIKKNLIGALLFDSGETAEATRLKRTA

RRRYTRRKNRICYLQEIFSNEMAKVDDSFFHRLEESFLVEEDKKHER

HPIFGNIVDEVAYHEKYPTIYHLRKKLVDSTDKADLRLIYLALAHMI

KFRGHFLIEGDLNPDNSDVDKLFIQLVQTYNQLFEENPINASGVDAK

AILSARLSKSRRLENLIAQLPGEKKNGLFGNLIALSLGLTPNFKSNF

DLAEDAKLQLSKDTYDDDLDNLLAQIGDQYADLFLAAKNLSDAILLS

DILRVNTEITKAPLSASMIKRYDEHHQDLTLLKALVRQQLPEKYKEI

FFDQSKNGYAGYIDGGASQEEFYKFIKPILEKMDGTEELLVKLNRED

LLRKQRTFDNGSIPHQIHLGELHAILRRQEDFYPFLKDNREKIEKIL

TFRIPYYVGPLARGNSRFAWMTRKSEETITPWNFEEVVDKGASAQSF

IERMTNFDKNLPNEKVLPKHSLLYEYFTVYNELTKVKYVTEGMRKPA

FLSGEQKKAIVDLLFKTNRKVTVKQLKEDYFKKIECFDSVEISGVED

RFNASLGTYHDLLKIIKDKDFLDNEENEDILEDIVLTLTLFEDREMI

EERLKTYAHLFDDKVMKQLKRRRYTGWGRLSRKLINGIRDKQSGKTI

LDFLKSDGFANRNFMQLIHDDSLTFKEDIQKAQVSGQGDSLHEHIAN

LAGSPAIKKGILQTVKVVDELVKVMGRHKPENIVIEMARENQTTQKG

QKNSRERMKRIEEGIKELGSQILKEHPVENTQLQNEKLYLYYLQNGR

DMYVDQELDINRLSDYDVDHIVPQSFLKDDSIDNKVLTRSDKNRGKS

DNVPSEEVVKKMKNYWRQLLNAKLITQRKFDNLTKAERGGLSELDKA

GFIKRQLVETRQITKHVAQILDSRMNTKYDENDKLIREVKVITLKSK

LVSDFRKDFQFYKVREINNYHHAHDAYLNAVVGTALIKKYPKLESEF

-continued

VYGDYKVYDVRKMIAKSEQEIGKATAKYFFYSNIMNFFKTEITLANG

EIRKRPLIETNGETGEIVWDKGRDFATVRKVLSMPQVNIVKKTEVQT

GGFSKESILPKRNSDKLIARKKDWDPKKYGGFDSPTVAYSVLVVAKV

EKGKSKKLKSVKELLGITIMERSSFEKNPIDFLEAKGYKEVKKDLII

KLPKYSLFELENGRKRMLASAGELQKGNELALPSKYVNFLYLASHYE

KLKGSPEDNEQKQLFVEQHKHYLDEIIEQISEFSKRVILADANLDKV

LSAYNKHRDKPIREQAENIIHLFTLTNLGAPAAFKYFDTTIDRKRYT

STKEVLDATLIHQSITGLYETRIDLSQLGGDSGGSGGSGGSTNLSDI

IEKETGKQLVIQESILMLPEEVEEVIGNKPESDILVHTAYDESTDEN

VMLLTSDAPEYKPWALVIQDSNGENKIKMLSGGSGGSGGSGGSTNLSDII

EKETGKQLVIQESILMLPEEVEEVIGNKPESDILVHTAYDESTDENV

MLLTSDAPEYKPWALVIQDSNGENKIKMLSGGSPKKKRK

SaBE4:

SEQ ID: 125

MSSETGPVAVDPTLRRRIEPHEFEVFFDPRELRKETCLLYEINWGGR

HSIWRHTSQNTNKHVEVNFIEKFTTERYFCPNTRCSITWFLSWSPCG

ECSRAITEFLSRYPHVTLFIYIARLYHHADPRNRQGLRDLISSGVTI

QIMTEQESGYCWRNFVNYSPSNEAHWPRYPHLWVRLYVLELYCIILG

LPPCLNILRRKQPQLTFFTIALQSCHYQRLPPHILWATGLKSGGSSG

GSSSGSETPGTSESATPESSGGSSGGGSGKRNYILGLAIGITSVGYGII

DYETRDVIDAGVRLFKEANVENNEGRRSKRGARRLKRRRRHRIQRVK

KLLFDYNLLTDHSELSGINPYEARVKGLSQKLSEEEFSAALLHLAKR

RGVHNVNEVEEDTGNELSTKEQISRNSKALEEKYVAELQLERLKKDG

EVRGSINRFKTSDYVKEAKQLLKVQKAYHQLDQSFIDTYIDLLETRR

TYYEGPGEGSPFGWKDIKEWYEMLMGHCTYFPEELRSVKYAYNADLY

NALNDLNNLVITRDENEKLEYYEKFQIIENVFKQKKKPTLKQIAKEI

LVNEEDIKGYRVTSTGKPEFTNLKVYHDIKDITARKEIIENAELLDQ

IAKILTIYQSSEDIQEELTNLNSELTQEEIEQISNLKGYTGTHNLSL

KAINLILDELWHTNDNQIAIFNRLKLVPKKVDLSQQKEIPTTLVDDF

ILSPVVKRSFIQSIKVINAIIKKYGLPNDIIIELAREKNSKDAQKMI

NEMQKRNRQTNERIEEIIRTTGKENAKYLIEKIKLHDMQEGKCLYSL

EAIPLEDLLNNPFNYEVDHIIPRSVSFDNSFNNKVLVKQEENSKKGN

RTPFQYLSSSDSKISYETFKKHILNLAKGKGRISKTKKEYLLEERDI

NRFSVQKDFINRNLVDTRYATRGLMNLLRSYFRVNNLDVKVKSINGG

FTSFLRRKWKFKKERNKGYKHHAEDALIIANADFIFKEWKKLDKAKK

VMENQMFEEKQAESMPEIETEQEYKEIFITPHQIKHIKDFKDYKYSH

RVDKKPNRELINDTLYSTRKDDKGNTLIVNNLNGLYDKDNDKLKKLI

NKSPEKLLMYHHDPQTYQKLKLIMEQYGDEKNPLYKYYEETGNYLTK

YSKKDNGPVIKKIKYYGNKLNAHLDITDDYPNSRNKVVKLSLKPYRF

DVYLDNGVYKFVTVKNLDVIKKENYYEVNSKCYEEAKKLKKISNQAE

FIASFYNNDLIKINGELYRVIGVNNDLLNRIEVNMIDITYREYLENM

NDKRPPRIIKTIASKTQSIKKYSTDILGNLYEVKSKKHPQIIKKGGS

PKKKRKVSSDYKDHDGDYKDHDIDYKDDDDKSGGSGGSGGSTNLSDI

IEKETGKQLVIQESILMLPEEVEEVIGNKPESDILVHTAYDESTDEN

VMLLTSDAPEYKPWALVIQDSNGENKIKMLSGGSGGSGGSGGSTNLSDII

EKETGKQLVIQESILMLPEEVEEVIGNKPESDILVHTAYDESTDENV

MLLTSDAPEYKPWALVIQDSNGENKIKMLSGGSPKKKRKV

SaBE4-Gam:

SEQ ID: 126

MAKPAKRIKSAAAAYVPQNRDAVITDIKRIGDLQREASRLETEMNDA

IAEITEKFAARIAPIKTDIETLSKGVQGWCEANRDELTNGGKVKTAN

LVTGDVSWRVRPPSVSIRGMDAVMETLERLGLQRFIRTKQEINKEAI

LLEPKAVAGVAGITVKSGIEDFSIIPFEQEAGISGSETPGTSESATP

ESSSETGPVAVDPTLRRRIEPHEFEVFFDPRELRKETCLLYEINWGG

RHSIWRHTSQNTNKHVEVNFIEKFTTERYFCPNTRCSITWFLSWSPC

GECSRAITEFLSRYPHVTLFIYIARLYHHADPRNRQGLRDLISSGVT

IQIMTEQESGYCWRNFVNYSPSNEAHWPRYPHLWVRLYVLELYCIIL

GLPPCLNILRRKQPQLTFFTIALQSCHYQRLPPHILWATGLKSGGSS

GGSSGSETPGTSESATPESSGGSSGGGSGKRNYILGLAIGITSVGYGI

IDYETRDVIDAGVRLFKEANVENNEGRRSKRGARRLKRRRRHRIQRV

KKLLFDYNLLTDHSELSGINPYEARVKGLSQKLSEEEFSAALLHLAK

RRGVHNVNEVEEDTGNELSTKEQISRNSKALEEKYVAELQLERLKKD

GEVRGSINRFKTSDYVKEAKQLLKVQKAYHQLDQSFIDTYIDLLETR

RTYYEGPGEGSPFGWKDIKEWYEMLMGHCTYFPEELRSVKYAYNADL

YNALNDLNNLVITRDENEKLEYYEKFQIIENVFKQKKKPTLKQIAKE

ILVNEEDIKGYRVTSTGKPEFTNLKVYHDIKDITARKEIIENAELLD

QIAKILTIYQSSEDIQEELTNLNSELTQEEIEQISNLKGYTGTHNLS

LKAINLILDELWHTNDNQIAIFNRLKLVPKKVDLSQQKEIPTTLVDD

FILSPVVKRSFIQSIKVINAIIKKYGLPNDIIIELAREKNSKDAQKM

INEMQKRNRQTNERIEEIIRTTGKENAKYLIEKIKLHDMQEGKCLYS

LEAIPLEDLLNNPFNYEVDHIIPRSVSFDNSFNNKVLVKQEENSKKG

NRTPFQYLSSSDSKISYETFKKHILNLAKGKGRISKTKKEYLLEERD

INRFSVQKDFINRNLVDTRYATRGLMNLLRSYFRVNNLDVKVKSING

GFTSFLRRKWKFKKERNKGYKHHAEDALIIANADFIFKEWKKLDKAK

KVMENQMFEEKQAESMPEIETEQEYKEIFITPHQIKHIKDFKDYKYS

HRVDKKPNRELINDTLYSTRKDDKGNTLIVNNLNGLYDKDNDKLKKL

INKSPEKLLMYHHDPQTYQKLKLIMEQYGDEKNPLYKYYEETGNYLT

KYSKKDNGPVIKKIKYYGNKLNAHLDITDDYPNSRNKVVKLSLKPYR

FDVYLDNGVYKFVTVKNLDVIKKENYYEVNSKCYEEAKKLKKISNQA

EFIASFYNNDLIKINGELYRVIGVNNDLLNRIEVNMIDITYREYLEN

MNDKRPPRIIKTIASKTQSIKKYSTDILGNLYEVKSKKHPQIIKKGG

SPKKKRKVSSDYKDHDGDYKDHDIDYKDDDDKSGGSGGSGGSTNLSD

IIEKETGKQLVIQESILMLPEEVEEVIGNKPESDILVHTAYDESTDE

-continued

NVMLLTSDAPEYKPWALVIQDSNGENKIKMLSGGSGGSGGSTNLSDI

IEKETGKQLVIQESILMLPEEVEEVIGNKPESDILVHTAYDESTDEN

VMLLTSDAPEYKPWALVIQDSNGENKIKMLSGGSPKKKRKV

BE4max and AncBE4max,

SEQ ID: 127
MKRTADGSEFESPKKKRKV[APOBEC or ancestral APOBEC, sequences see below]SGGSSGGSSGSETPGTSESATPESSGG

SSGGSDKKYSIGLAIGTNSVGWAVITDEYKVPSKKFKVLGNTDRHSI

KKNLIGALLFDSGETAEATRLKRTARRRYTRRKNRICYLQEIFSNEM

AKVDDSFFHRLEESFLVEEDKKHERHPIFGNIVDEVAYHEKYPTIYH

LRKKLVDSTDKADLRLIYLALAHMIKFRGHFLIEGDLNPDNSDVDKL

FIQLVQTYNQLFEENPINASGVDAKAILSARLSKSRRLENLIAQLPG

EKKNGLFGNLIALSLGLTPNFKSNFDLAEDAKLQLSKDTYDDDLDNL

LAQIGDQYADLFLAAKNLSDAILLSDILRVNTEITKAPLSASMIKRY

DEHHQDLTLLKALVRQQLPEKYKEIFFDQSKNGYAGYIDGGASQEEF

YKFIKPILEKMDGTEELLVKLNREDLLRKQRTFDNGSIPHQIHLGEL

HAILRRQEDFYPFLKDNREKIEKILTFRIPYYVGPLARGNSRFAWMT

RKSEETITPWNFEEVVDKGASAQSFIERMTNFDKNLPNEKVLPKHSL

LYEYFTVYNELTKVKYVTEGMRKPAFLSGEQKKAIVDLLFKTNRKVT

VKQLKEDYFKKIECFDSVEISGVEDRFNASLGTYHDLLKIIKDKDFL

DNEENEDILEDIVLTLTLFEDREMIEERLKTYAHLFDDKVMKQLKRR

RYTGWGRLSRKLINGIRDKQSGKTILDFLKSDGFANRNFMQLIHDDS

LTFKEDIQKAQVSGQGDSLHEHIANLAGSPAIKKGILQTVKVVDELV

KVMGRHKPENIVIEMARENQTTQKGQKNSRERMKRIEEGIKELGSQI

LKEHPVENTQLQNEKLYLYYLQNGRDMYVDQELDINRLSDYDVDHIV

PQSFLKDDSIDNKVLTRSDKNRGKSDNVPSEEVVKKMKNYWRQLLNA

KLITQRKFDNLTKAERGGLSELDKAGFIKRQLVETRQITKHVAQILD

SRMNTKYDENDKLIREVKVITLKSKLVSDFRKDFQFYKVREINNYHH

AHDAYLNAVVGTALIKKYPKLESEFVYGDYKVYDVRKMIAKSEQEIG

KATAKYFFYSNIMNFFKTEITLANGEIRKRPLIETNGETGEIVWDKG

RDFATVRKVLSMPQVNIVKKTEVQTGGFSKESILPKRNSDKLIARKK

DWDPKKYGGFDSPTVAYSVLVVAKVEKGKSKKLKSVKELLGITIMER

SSFEKNPIDFLEAKGYKEVKKDLIIKLPKYSLFELENGRKRMLASAG

ELQKGNELALPSKYVNFLYLASHYEKLKGSPEDNEQKQLFVEQHKHY

LDEIIEQISEFSKRVILADANLDKVLSAYNKHRDKPIREQAENIIHL

FTLTNLGAPAAFKYFDTTIDRKRYTSTKEVLDATLIHQSITGLYETR

IDLSQLGGDSGGSGGSGGSTNLSDIIEKETGKQLVIQESILMLPEEV

EEVIGNKPESDILVHTAYDESTDENVMLLTSDAPEYKPWALVIQDSN

GENKIKML_SGGSGGSGGS_TNLSDIIEKETGKQLVIQESILMLPEE

VEEVIGNKPESDILVHTAYDESTDENVMLLTSDAPEYKPWALVIQDS

NGENKIKMLSGGSKRTADGSEFEPKKKRKV

Rat APOBEC1,

-continued

SEQ ID: 128
SSETGPVAVDPTLRRRIEPHEFEVFFDPRELRKETCLLYEINWGGRH

SIWRHTSQNTNKHVEVNFIEKFTTERYFCPNTRCSITWFLSWSPCGE

CSRAITEFLSRYPHVTLFIYIARLYHHADPRNRQGLRDLISSGVTIQ

IMTEQESGYCWRNFVNYSPSNEAHWPRYPHLWVRLYVLELYCIILGL

PPCLNILRRKQPQLTFFTIALQSCHYQRLPPHILWATGLK

Anc689 APOBEC,

SEQ ID: 129
SSETGPVAVDPTLRRRIEPHEFEVFFDPRELRKETCLLYEIKWGTSH

KIWRHSSKNTTKHVEVNFIEKFTSERHFCPSTSCSITWFLSWSPCGE

CSKAITEFLSQHPNVTLVIYVARLYHHMDQQNRQGLRDLVNSGVTIQ

IMTAPEYDYCWRNFVNYPPGKEAHWPRYPPLWMKLYALELHAGILGL

PPCLNILRRKQPQLTFFTIALQSCHYQRLPPHILWATGLK

Anc687 APOBEC,

SEQ ID: 130
SSETGPVAVDPTLRRRIEPHEFEVFFDPRELRKEACLLYEIKWGTSH

KIWRNSGKNTTKHVEVNFIEKFTSERHFCPSISCSITWFLSWSPCWE

CSKAIREFLSQHPNVTLVIYVARLFQHMDQQNRQGLRDLVNSGVTIQ

IMTASEYDHCWRNFVNYPPGKEAHWPRYPPLWMKLYALELHAGILGL

PPCLNILRRKQPQLTFFTIALQSCHYQRLPPHILWATGLK

Anc686 APOBEC,

SEQ ID: 131
SSETGPVAVDPTLRRRIEPEFFNRNYDPRELRKETYLLYEIKWGKES

KIWRHTSNNRTQHAEVNFLENFFNELYFNPSTHCSITWFLSWSPCGE

CSKAIVEFLKEHPNVLEIYVARLYLCEDERNRQGLRDLVNSGVTIR

IMNLPDYNYCWRTFVSHQGGDEDYWPRHFAPWVRLYVLELYCIILGL

PPCLNILRRKQPQLTFFTIALQSCHYQRLPPHILWATGLK

Anc655 APOBEC,

SEQ ID: 132
SSETGPVAVDPTLRRRIEPFYFQFNNDPRACRRKTYLCYELKQDGST

WVWKRTLHNKGRHAEICFLEKISSLEKLDPAQHYRITWYMSWSPCSN

CAQKIVDFLKEHPHVNLRIYVARLYYHEEERYQEGLRNLRRSGVSIR

VMDLPDFEHCWETFVDNGGGPFQPWPGLEELNSKQLSRRLQAGILGL

PPCLNILRRKQPQLTFFTIALQSCHYQRLPPHILWATGLK

Anc733 APOBEC,

SEQ ID: 133
SSETGPVAVDPTLRRRIEPFHFQFNNDPRAYRRKTYLCYELKQDGST

WVLDRTLRNKGRHAEICFLDKINSWERLDPAQHYRVTWYMSWSPCSN

CAQQVVDFLKEHPHVNLRIFAARLYYHEQRRYQEGLRSLRGSGVPVA

VMTLPDFEHCWETFVDHGGRPFQPWDGLEELNSRSLSRRLQAGILGL

PPCLNILRRKQPQLTFFTIALQSCHYQRLPPHILWATGLK

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1586 sequences)

SEQ ID NO: 1 - protein, 223 aa, Loxodonta africana
FRRRIKPWEFEIFFDPRQLRKETCLLYEIKWGTSHKVWRNSGQNTTKHVEVNFIEKFTSERKLCPSISCSITWFLSWSPCWECSKAIREFLRQHPNVTLVIYVARLFHHMDQRNRQGLKDLILSGITVQIMRVSEYHHCWRNFVSYSPGEETYWPRYPPLWMMMYALELHCIILSLPPCLKISRRCQHQLTLFSLTPQKCHYQMIPPYILLATGLIEPPMTWR

SEQ ID NO: 2 - protein, 201 aa, Protopterus annectens
MVQKRTSASKTRMTKKVLLSEYQKFYYSPRTCIGYVIQYDEDNVIFQNWICNKRTTHAELQCIYEIKQNSLIKRFTPCTLKWYMSWTPCSECANEIIRFLNKFCQVKLEICAARIYFHKKKDNRRALRNLVKAGVKLTTMRWKDYKSMWRRFGTGEEIKKYEFFEKSSDHKSVNWRWTLKKILKEKDRDSDLENALSLLKI

SEQ ID NO: 3 - protein, 198 aa, Alligator mississippiensis
MAVEEEKGLLGTSQGWKIELKDFQENYMPSTWPKVTHLLYEIRWGKGSKVWRNWCSNTLTQHAEVNCLENAFGKLQFNPPVPCHITWFLSWSPCCQCCRRILQFLRAHSHITLVIKAAQLFKHMDERNRQGLRDLVQSGVHVQVMDLPDYRYCWRTFVSHPHEGEGDFWPWFFPLWITFYTLELQHILLQQHALSYNL

SEQ ID NO: 4 - protein, 182 aa, Anolis carolinensis
KAAILLSNLFFRWQMEPEAFQRNFDPREFPECTLLLYEIHWDNNTSRNWCTNKPGLHAEENFLQIFNEKIDIKQDTPCSITWFLSWSPCYPCSQAIIKFLEAHPNVSLEIKAARLYMHQIDCNKEGLRNLGRNRVSIMNLPDYRHCWTTFVVPRGANEDYWPQDFLPAITNYSRELDSILQD

SEQ ID NO: 5 - protein, 142 aa, Corvus brachyrhynchos
RWKIEPGDFQINYSPSQHRRGVYLLYEIRWRRGSIWRNWCSNTHRQHAEVNFLENCFKDRPQVPCSITWFLSASPCGKCSKRILEFLKSRPYVTLKIYAAKLFRHHDIRNREGLCNLGMHGVTIHIMNLEDYSYCWRNFVVY

SEQ ID NO: 6 - protein, 142 aa, Calypte anna
RWKIQPNDFKRNYQPGRRPNVVYLLYEIRWRRGTIWRNWCSNEFPQHAEDNFFQNRFNAVPSVSCSITWFLSTTPCGRCSKRILEFLRLHPNVTLKIYAARLFRHLDNRNRQGLRKLASNGVIIQIMGLPDYSYSWKKFVAY

SEQ ID NO: 7 - protein, 237 aa, Tursiops truncatus
MIICWSTGPSAGDATLRRRIEPWEFEVSFDPRELSKETRLLYEIKWGKSQRIWRHSGKNTTKHVERNFIEQITSERRFHRSVSCCIIWFLSWSPCWECSEAIREFLKQHPRVTLLIYVARLFQHMDPRNRQGLRDLTHSGVTIQIMGPTEYDYCWRYFVNYAPGKEAHWPRYPPLLMKLYALELHCIILGLPPCLNISRYQNQLTLFRPILRNCHYQMIPPHILLHTGLIQLPLTWR

SEQ ID NO: 8 - protein, 142 aa, Tyto alba
RWKIQPNDFKRNFLPGQHPKVVYLMYEIRWIRGTAWRSWCSNNSKQDAEVNLLENCFKAMPSVFCSVTWVLFTTPCGKCFRRILEFLRVHSNVALERYAAQLFRHLDICNWQGIRSLAMNGVIIHIMNLADYSYCWKRFVAY

SEQ ID NO: 9 - protein, 244 aa, Pteropus alecto
MWVLFDILISWSTGPSTGDPTLRRRIEPWEFEVFFDPRELRKEACLLYEIQWGTSHKIWRNSGKNTTKHVELNFIEKFTSERHFCSSVSCSIIWFLSWSPCWECSKAIREFLSQRPTVTLVIFVSRLFQHMDQQNRQGLRDLINSGVTIQIMRASEYDHCWRNFVNYPPGKEAHWPRYPPLWMKLYALELHCIILSLPPCVMISRRCQKQLTLFTLILKKCHYQMIPAHILLATGLIQVPVTWR

SEQ ID NO: 10 - protein, 236 aa, Rhinopithecus bieti
MTSEKGPSTGDPTLRRRIEPWEFDIFYDPRELRKEACLLYEIKWGMSWKIWRSSGKNTTNHVEVNFIEKFTSERRFHSSISCSITWFLSWSPCWDCSQAIRKFLSQHPGVTLVIYVARLFWHTDQQNRQGLRDLVNSGVTIQMMTASEYYHCWRNFVNYPPGEEAHWPRYPPLWMMLYALELHCIILSLPPCLKISRRWQNHLTFFRLHLQNCHYQTIPPHILLATGLIQPSVTWR

SEQ ID NO: 11 - protein, 237 aa, Delphinapterus leucas
MIICWSTGPSAGDATSRRRIEPWEFEVSFDPRELCKETRLLYEIKWGKSQHVWRHSDKNTTKHVECKFIEKITSERHFHPSVSCCIIWFLSWSPCWECSKAIREFLNQHPRVTLFIYVARLFQHMDPQNRQGLRDLIHSGVTIHVMGPTEYDYCWRNFVNYPPGKEAHWPRYPPMLMKLYALELHCIILGLPPCLNISRYQNQLTLFRLIPQNCHYRMIPPHILLHRGLIRLPLTWR

SEQ ID NO: 12 - protein, 184 aa, Lonchura domestica
MYRRKMRGMYISKRALRKHFDPRNYPRETYLLCELQWRGSHKSWQHWLRNDDSKDCHAEKYFLEEIFEPRSYNICDMTWYLSWSPCGECCDIIQDFLEEQPNVNINIRIARLYYADRASNRRGLMELANSPGVSIEIMDADDYNDCWETFIQPGVYYRFSPENFESAIRRNCSQLEDILQGLHL

SEQ ID NO: 13 - protein, 295 aa, Amazona aestiva
  MOD_RES (27)..(27): Any amino acid
  MOD_RES (87)..(87): Any amino acid
  MOD_RES (182)..(182): Any amino acid
  MOD_RES (201)..(201): Any amino acid
MLPAPAPVPLVLPLQGGGVVVVTVGVXPTALLQPSGAPEVARTFVGAVIAFVIAEYVDTSVSEDTTICGMYIPKEALKYHFDPREVXRDTYLLCILRWGETGTPWSHWVKNYRYHAEVYFLEKIFQTRKSSKNINCSITWYLSWSPCAKCCRKILNFLKKHSYVSIKIHVARLFRIDDKETXQNLKNLGSLVGVTVSVMEXEDYTNCWKTFIRGHADGDSWIDDLKSEIRKNRLKFQGIFKDLPHQTEDVDFWLILAANPGPAWFSFSGYTGWAVASKAPSLLSPLSCLTRLLTP

SEQ ID NO: 14 - protein, 177 aa, Saimiri boliviensis
MTSERRRIEPWEFSISYDPRELCKETCLLYEIKWGMSWKIWRSSGKNTTNHVEVNFIEKFTSERHFHSSVSCSITWFLSWSPCWECSQAIREFLSQHPGVTLVIYVARLFQHMDQQNRQGLRELVNSGVTIQIMTASEYYHCWRNFVNYPPGEEAHWPRHPPLWMMLYALELHCIIL

SEQ ID NO: 15 - protein, 218 aa, Pan paniscus
ISWSTGPSTGDPTLRRRIEPWEFDVFYDPRELRKEACLLYEIKWGMSRKIWRSSERDFHPSISCSITWFLSWSPCWECSQAIREFLSQHPGVTLVIYVARLFWHMDQQNRQGLRDLVNSGVTIQIMTASEYYHCWRNFVNYPPGDEAHWPQYPPLWMMLYALELHCIILSLPPCLKISRRWQNHLTFFSLHLQNCHYQTIPPHILLATGLIHPSVAWR

SEQ ID NO: 16 - protein, 236 aa, Pongo pygmaeus
MTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWR

SEQ ID NO: 17 - protein, 236 aa, Bos taurus
MASDRGPPAGDPTLRRRIEPWEFEFSFDPRKFCKEACLLYEIQWGNNRDVWRHSGKNTTKHVERNFIEKIASERYFCPSIRCFIFWYLSWSPCWECSKAIREFLNQHPNVTLVIYIARLFQHMDPQNRQGLKDLVQSGVTIQVMRAPEYEYCWRNFVNYPRGKEAHWPRYPPLWMNLYALELYCIILGLPPCLHISRRYQNQLIVFRLTLQNCHYQMIPPYILLATGMVQLPMTWR

SEQ ID NO: 18 - protein, 107 aa, Myotis brandtii
MDEQNRQGLRDLIKSGVTVQIMTTPEYDYCWRNFVNYPPGKDTHCPMYPPLWMKLYALELHCIILSLPPCLMISRRCQKQLTWYRLNLQNCHYQQIPHHILLATVWI

SEQ ID NO: 19 - protein, 236 aa, Felis catus
MASDKGPSAGDATLRRRIEPREFEVFFDPRELRKEACLLYEIKWGTSHRIWRNSGRNTANHVELNFIEKFTSERHFCPSVSCSITWFLSWSPCWECSKAIRGFLSQHPSVTLVIYVSRLFWHLDQQNRQGLRDLVNSGVTVQIMRVPEYDHCWRNFVNYPPGEEDHWPRYPVVWMKLYALELHCIILSLPPCLKILRRCQNQLTLFRLTLQNCHYQMIPPHILLATGLIQLPVTWR

SEQ ID NO: 20 - protein, 236 aa, Cebus capucinus
MTSERGPSTGDPTLRRRIEPWEFYISYDPKELCKETCLLYEIKWGMSWKIWRSSGKNTTNHVEVNFIEKFTSERRFHSSISCSITWFLSWSPCWECSQAIREFLSQHPGVTLVIYVARLFQHMDQQNRQGLRDLVNSGVTIQIMRASEYYYCWRNFVNYPPGEEAHWPRHPPLWMMLYALELHCIILGLPPCLKISRRRQNRLTFFRLHLQNCHYQMIPPHILLAAGLIQPSVTWR

SEQ ID NO: 21 - protein, 236 aa, Pan troglodytes
MTSEKGPSTGDPTLRRRIEPWEFDVFYDPRELRKEACLLYEIKWGMSRKIWRSSGKNTTNHVEVNFIKKFTSERHFHPSISCSITWFLSWSPCWECSQAIREFLSQHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFSLHLQNCHYQTIPPHILLATGLIHPSVAWR

SEQ ID NO: 22 - protein, 238 aa, Alligator sinensis
MGEHWQYAGSGEYIPQDQFEENFDPSVLLAETHLLSELTWGGRPYKHWYENTEHCHAEIHFLENFSSKNRSCTITWYLSWSPCAECSARIADFMQENTNVKLNIHVARLYLHDDEHTRQGLRYLMKMKRVTIQVMTIPDYTYCWNTFLEDDGEDESDDYGGYAGVHEDEDESDDDDYLPTHFAPWIMLYSLELSCILQGFAPCLKIIQGNHMSPTFQLHVQDQEQKRLLEPANPWGAD

SEQ ID NO: 23 - protein, 86 aa, Cricetulus griseus
MTEQEYCYCWRNFVNYPPSNEVYWPRYPNVWMRMYALELYCIVLGLPPCLKIIRRHQHPLTFFTLHLQSCHYQRIPPHILWATGLV

SEQ ID NO: 24 - protein, 142 aa, Antrostomus carolinensis
RWKMQPNDFKRNYLPVQYPNMVYLLYEIRWSTGTIWRNWCSNNSTQHAEVNFLENRFNSRPSVSCSITWVLSTTPCGKCSTKILEFLRLHPNVTLKIYAAKLFKHLDIRNRQGLRNLAMNGVIIRIMNLADYSYCWKTFVAY

SEQ ID NO: 25 - protein, 226 aa, Propithecus coquereli
MTSEKRRIEPWEFEAFFDPRELRKEACLLYEIKWGASHKIWRNTGKSTTRHVEVNFIEKFTSERRSDSLISCSITWFLSWSPCWECSKAIREFLSQHPNVTLVIYVARLFWHMNQQNRQGLRDLINSGVTVQIMGVSEYCHCWRNFVNYPPGKEASCPTYPPLWMTLYALELHCIILSLPPCLKISRRCQNQLTFFRLTPQNCHYQTIPPHILLATGLIQPSVTWR

SEQ ID NO: 26 - protein, 231 aa, Macaca fascicularis
GPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMRASEYYHCWRNFVNYPPGEEAHWPRYPPLWMMLYALELHCIILSLPPCLKISRRWQNHLTFFRLHLQNCHYQMIPPHILLATGLIQPSVTWR

SEQ ID NO: 27 - protein, 142 aa, Nipponia nippon
RWKIQPNDFRSNYLPCQHPRVVYLLYEIRWSRGTIWRNWCSNNSTQHAEVNFLENCFKAMPSVPCSITWVLSTTPCGKCSRRILEFLRVHPNVTLEIYAAKLFKHLDIRNRQGLRNLAKNGVVIRIMKLADYSYWWKRFVAY

SEQ ID NO: 28 - protein, 142 aa, Pelecanus crispus
RWKLQPEDFKRNYLPGQHPKVVYLLYEIRWSRGTIWRSWCSNNSKQHAEVNFLENCFKARPSVSCSITWVLSTTPCGKCSRRILEFLRVHPNVTLEIYAAKLFKHLDIRNQQGLRNLAMNGVIIRIMNLADYSYCWKRFVAH

SEQ ID NO: 29 - protein, 93 aa, Fukomys damarensis
MSDPEFCHCWRNFVNYPPGQEARWPRFPPVWTMLYTLELCCVLLNLPPCLKISRRCHNQLAFFQLNLQNCHYRAIPPAVLFAVGLIHPFVAWA

SEQ ID NO: 30 - protein, 240 aa, Myotis davidii
MASDAGKMDRGPVSFIVLKSVETLCVRRIEPWEFEAIFDPRELRKEACLLYEIKWGTGHKIWRHSGKNTTRHVEVNFIEKITSERQFCSSTSCSIIWFLSWSPCWECSKAITEFLRQRPGVTLVIYVARLYHHMDEQNRQGLRDLVKSGVTVQIMTTPEYDYCWRNFVNYPPGKDTHCPIYPPLLMKLYALELHCIILSLPPCLMISRRCQKQLTWYRLNLQNCHYQQIPHHILLATAWI

SEQ ID NO: 31 - protein, 236 aa, Canis lupus
MASDKGPSAGDATLRRRIEPWEFEGFFDPRELRKETCLLYEIQWGTSHKTWRNSGKNTTNHVEINFMEKFAAERQYCPSIRCSITWFLSWSPCWECSNAIRGFLSQHPSVTLVIYVARLFWHTDPQNRQGLRDLINSGVTIQIMTVPEYDHCWRNFVNYPPGKEDHWPRYPVLWMKLYALELHCIILNLPPCLKISRRNQHQLTLFRLTLQDCHYQTIPPPILLDMGLIQPLVTWR

SEQ ID NO: 32 - protein, 142 aa, Dryobates pubescens
RWKIHPDEFKLNYVPVGRPRVVYLLYEIRWSRGSIWRNWCSNSSTQHAEVNFLENCFKAMPSVSCSITWFLSTTPCGNCSRRILEFLRAHPKVTLAIHAAKLFKHLDVRNRHGLKALATDGVVLHIMSIADYRYCWTKFVAY

SEQ ID NO: 33 - protein, 236 aa, Mandrillus leucophaeus
MTSEKGPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMRASEYYHCWRNFVNYPPGEEAHWPRYPPLWMMLYALELHCIILSLPPCLKISRRQQNHLTFFRLHLQNCHYQTIPPHILLATGLIQPSVTWR

SEQ ID NO: 34 - protein, 142 aa, Balearica regulorum
RWKIQPDDFKRNYLPGKHPRVVYLLYEIRWSRGTIWRSWCSNNATQHAEINFLETCFLARTSVSCSITWVLSTTPCGKCSRRILEFLNAYPNVTLEIYAAKLFRHLDNRNRQGLRNLAMKGVRIHIMNLADYSYFWKIFVAY

SEQ ID NO: 35 - protein, 142 aa, Aptenodytes forsteri
RWKIRPNDFKRNYLPGQHPKVVYLLYEIRWSRGTIWRNWCSNNSTQHAEVNFLENCFKAMPSVSCSITWVLSTTPCGKCSRRILEFLRVHPNVTLEIYAAKLFKHLDIRNRQGLRNLAMNGVIIRIMNLADYSYGWKRFVAY

SEQ ID NO: 36 - protein, 236 aa, Enhydra lutris
MASDKGPSAGDATLRRRIEPWEFEVFFDPRELRKEACLLYEIQWGTSHKMWRNTGKNTANHVELNFIEKFTSERRYCPSTHCSITWFLSWSPCWECCKAIRGFLSQHPSVTLVIYVTRLFWHMDPQNRQGLRDLLKSGVTVQIMRAPEYDHCWKNFVNYPPGKEDHWPRYPELWMKLYELELYCIILSLPPCLKISRRNQNQLTLFRLTLQNCHYQIIPPHILLDTGLIQLPVIWR

SEQ ID NO: 37 - protein, 236 aa, Mustela furo
MASDKGPSAGDATLRRRIEPWEFEVFFDPRELRKEACLLYEIQWGTSHKMWRNTGKNTANHVELNFIEKFTSERRYCPSTHCSITWFLSWSPCWECSKAIRGFLSQCPSVTLVIYVTRLFWHMDPQNRQGLRDLLKSGVTVRIMRAPEYDHCWKNFVNYPPGKEDHWPRYPELWMKLYELELYCIILSLPPCLKISRRNQKQLTLFRLTLQNCHYQIIPPHILLDTGLIQLPVIWR

SEQ ID NO: 38 - protein, 248 aa, Trichechus manatus
MTSEEADQRHSTMTSEKGPSTGDGTLRRRITPWEFEIFFDPRELRKETCLLYEIKWGTSHRIWRNSGQNTTKHAEVNFIEKFTSERNFCPSVSCSITWFLSWSPCWECSKAIREFLSQHPNVILVIYVARLFHHMDQQNREGLRDLVLSGVTVQIMSVSEYGHCWRNFVNYPPGEEARWPRYPPLWMMLYALELHCIILGLPPCLKISRRRQSQLTLFSLTPQNCHYQMIPPHILLATGLIQPYVTWR

SEQ ID NO: 39 - protein, 235 aa, Ailuropoda melanoleuca
ISWSTGPSGGDATSRRRIEPWEFEVFFDPRQLRKEACLLYEIQWGTSRKIWRNSGKNTTNHVEINFIEKFTLERQYCPSIHCSVTWFLSWSPCWECSKAIRAFLSQHPSVTLVIYVARLFWHMEPQNRQGLRDLINSGVTIQIMSVPEYDHCWRNFVNYPPGKDHWPGYPVLWMKLYALELHCIILSLPPCLKISRRNQNQLTLFRLTLQNCHYQTIPPHVLLATGLIQLPVTWR

SEQ ID NO: 40 - protein, 142 aa, Manacus vitellinus
RWKIQPKDFKRNYLPGQHPQVVYLLYEIRWRNGSIWRNWFSNNRNQHAEVNFLENCFSDVPPAPCSITWFLSTSPCGKCSRRILEFLRTHRNVTLEIYAAKLFRHQDIRNRQGLCNLVMNGVTIHIMNLADYSYCWKRFVAY

SEQ ID NO: 41 - protein, 229 aa, Mesocricetus auratus
MSSETGPVVVDPTLRRRIEPHEFDAFFDQGELRKETCLLYEIRWGGRHNIWRHTGQNTSRHVEINFIEKFTSERYFYPSTRCSIVWFLSWSPCGECSKAITEFLSGHPNVTLFIYAARLYHHTDQRNRQGLRDLISRGVTIRIMTEQEYCYCWRNFVNYPPSNEVYWPRYPNLWMRLYALELYCIHLGLPPCLKIKRRHQYPLTFFRLNLQSCHYQRIPPHILWATGFI

SEQ ID NO: 42 - protein, 191 aa, Rhinopithecus roxellana
MSWKIWRSSGKNTTNHVEVNFIEKFTSERRFHSSISCSITWFLSWSPCWDCSQAIRKFLSQHPGVTLVIYVARLFWHTDQQNRQGLRDLVNSGVTIQMMTASEYYHCWRNFVNYPPGEEAHWPRYPPLWMMLYALELHCIILSLPPCLKISRRWQNHLTFFRLRLQNCHYQTIPPHILLATGLIQPSVTWR

SEQ ID NO: 43 - protein, 191 aa, Chlorocebus sabaeus
MSRKIWRSSGKNTTNHVEVNFIEKLTSERRFHSSVSCSVTWFLSWSPCWECSQAIREFLSQHPGVTLVIYVARLFWHTDQQNRQGLRDLVNSGVTIQIMRASEYYHCWRNFVNYPPGEEAHWPRYPPLWMMLYALELHCIILSLPPCLKISRRWQNHLTFFRLHLQNCHYQTIPPHILLATGLIQPPVTWR

SEQ ID NO: 44 - protein, 236 aa, Cavia porcellus
MASGTGPSTGDATLRRRIEPWQFEAYFDPRQLRKEACMLSEVRWGASPRTWRESSLNTTSHVEINFIEKFTSGRSLRPAVRCSMTWFLSWSPCWECARAIREFLHQHPNVSLVIYVARLYWHVDEQNRQGLRDLVTSGVRVQIMSDSEYRHCWRNFVNFPPGQEAGWPRFPPMWTTLYALELSCILLSLPPCLKISRRRQYRLIVFQLILQTCHYRAIPPQVLSAAELMHPLVAWC

SEQ ID NO: 45 - protein, 235 aa, Neomonachus schauinslandi
MASDKGPSAGDATLRRRIKPWEFEVFFDPRELRKETCLLYEIQWGTSHKIWRNSGKNTANHVEINFIEKFTSERQYCPSIRCSITWFLSWSPCWECSKAIRGFLSQHPSVTLVIYVARLFWHMDPQNRQGLRDLINSGVTIQIMRVPEYDHCWRNFVNYLPGKEDHWPRYPVLWMKLYALELHCIILSLPPCLRISRRQNQLTLFTLTLQNCHYQMIPPHILLATGLIQVPVTWK

SEQ ID NO: 46 - protein, 142 aa, Opisthocomus hoazin
RWKVQPNDFKRNYLPGQHPKVVYILYEIRWSRGTIWRNWCTNNSTQHAEVNFLENCFKAMPSVSCSITWVLSTTPCGKCSKRIQDFLRIYPNVTLEIHAAKLFKHLDTRNREGLRNLAKDGVIIHIMNLADYSYWWKRFVAY

SEQ ID NO: 47 - protein, 222 aa, Equus caballus
RRRIQPWEFEAFFDPRELRKEACLLYEIKWGMSHNIWRYSGKNTTKHVEINFIEKFTSERHLRPSISCSIVWFLSWSPCWECSKAIREFLSQHPNVTLVIYVARLFQHMDRLNRQGLRDLINSGVTIQIMRTSEYDHCWRNFVNYPPGKEAHWPRYSLLWMKLYALELHCIILSLPPCLMISRRCQNQLTFFRLTLQNCHYQMIPPHILLATGLVQLPVTWR

SEQ ID NO: 48 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 49 - protein, 142 aa, Nestor notabilis
RWKIQPNDFKRNYLPYQHPKVVCLLYEIRWNRGTIWRSWCSNNSTQHAEVNFLENCFKAKPSVSCSITWVLSTTPCGECSRRILDFLSVYPNVTLKIYAAKLFKHLDNRNRQGLWNLANNRVIIRIMNLEDYNYYWKRFVAY

SEQ ID NO: 50 - protein, 142 aa, Egretta garzetta
RWKIQPNDFKRNYLPGQHPKVVYLLYEIRWSRGTIWRNWCSNNSTQHAEVNFLENCFKAMPSVSCSITWVLSTTPCGKCSRRILEFLRVHPSVTLEIYAAKLFKHLDIRNRQGLRNLAMNGVIIHIMNLADYSYWWKIFVAY

SEQ ID NO: 51 - protein, 248 aa, Aotus nancymaae
MTPEEEVQRQSTMTSERGPSTGDPTLRRRIEPWEFCISYDPKELCKETCLLYEIKWGTSWKIWRSSGKNTTNHVEVNFIEKFMSERHFHSSISCSITWFLSWSPCWECSQAIREFLSRHPGVTLVIYVARLFQHMDRQNRQGLRDLVNSGVTIQIMRASEYYHCWRNFVNYPPGEEAHWPRYPPLWMMLYALELHCIILGLPPCLKISRRWQNRLTFFRLHLQNCHYQMIPQHILFATGLIQPPVTWR

SEQ ID NO: 52 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 53 - protein, 221 aa, Heterocephalus glaber
RRRIEPWQFEASFDPRQLRRETCLLSEVRWGTSPRAWRGCSLNTARHAEVSFMDRLTSEGRLRGPVRCSITWFLSWSPCGACAQAIGEFLRQHPNVSLVIYIARLFWHVDEQNRQGLRDLVTRGVRMQVMSDPEFAHCWRNFVNYSPGQEARWPQVPPVWTWLYSLELHCILLNLPPCLKISRRHHNQLTFFQLILQNCHYQAIPSPVLLASGLIHPFVTW

SEQ ID NO: 54 - protein, 142 aa, Merops nubicus
RWKIEPDEFKTNYSPDHRPRVVYLLYEIRWRRGTIWRNWCSNNIDQHAEVNFLENCFKAKPSVSCSITWFLSTAPCAKCSRRILKFLTAHPKVTLEIYAAKLFRHLEIRNRQGLMDLAVNGVILRIMNLADYSYCWKQFVAY

SEQ ID NO: 55 - protein, 142 aa, Fulmarus glacialis
RWKIQPNDFKRNFLPSKYPKVVYLLYEIRWSSGTIWRSWCSNNSTQHAEVNFLENCFKAMPSVSCSITWVLPITPCGKCSKKILEFLSVHPNVTLEIYAAKLFRHLDIRNQQGLRNLAMNGVIIRIMNLADYSYSWKRFVAY

SEQ ID NO: 56 - protein, 236 aa, Nomascus leucogenys
MTSEKGPSTGDPTLRRRIEPWEFDVFYDPRELRKEACLLYEIKWGMSQKIWRSSGKNTTNHVEVNFIKKFTSEGRFQSSISCSITWFLSWSPCWECSQAIREFLSQHPGVTLVIYVARLFWHMDQQNRQGLRDLVNSGVTIQIMRASEYYHCWRNFVNYPPGDEAHWPRYPPLWMMLYALELHCIILSLPPCLKISRRWQNHLTFFRLHLQNCHYQTIPPHILLATGLIHPSVTWR

SEQ ID NO: 57 - protein, 236 aa, Papio anubis
MTSEKGPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMTASEYYHCWRNFVNYPPGEEAHWPRYPPLWMMLYALELHCIILSLPPCLKISRRWQNHLTFFRLHLQNCHYQTIPPHILLATGLIQPSVTWR

SEQ ID NO: 58 - protein, 235 aa, Monodelphis domestica
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 59 - protein, 262 aa, Dipodomys ordii
MHHSARLPPNCIVSRYANAPWTVLPLPLPPTEAPATGDDTLRRRIEPWEFEAFFNPQELRREACLLYQITWSSHKVWRETAKNTVDSHVEVNFIQNLTAGRYCRPSTRCSILWFLSWSPCSSCSKAIRLFLSQHPGVSLVIYVARLFQHMDPQNRQGLRELIHSGVTIQVMRPQEYDYCWKNFVNYPPGQEEHWPRYPVQCMTLYNLELYCIIHNLPPCVRISKQRQSQLAFFSLGLENVHYQRIPPPLLLLTGLVFVFPWK

SEQ ID NO: 60 - protein, 235 aa, Odobenus rosmarus
MASDKGPSAGDATLRRRIEPWEFEVFFDPRELRKEACLLYEIQWGTSHKIWRNSGKNTSNHVEINFIEKFTSERQYCPSIHCSITWFLSWSPCWECSEAIRGFLSQHPSVTLVIYVARLFWHMDPQNRQGLRDLINSGVTIQIMRVPEYDHCWRNFVNYPPGKEDHWPRYPVLWMKLYALELHCIILSLPPCLRISRRQNQLTLFRLTLQNCHYQMIPPHILLATGLIQVPVTWK

SEQ ID NO: 61 - protein, 330 aa, Patagioenas fasciata
MRRKKPSGMYISKRALKDNFDPHKFPHDTYLLCKLQWGDTGRSWIHWIRKDRYHAEVYFLEKIFKMRRSKNYVNCSITWYLSWSPCVRCCCEILNFLEKHSYVNIDIYVARLYKIQNSEVREGLKKLVSSKKVTIAVMEIKDYTYCWKNFIQGDADDDSWTVDFQSAITKNRLKLKDVFEFLKSHPNVTLEIYAAKLFKHLDIRNREGLRNLAKNGVIIHIMNLADYSYWWKIFVTRQHGEDDYLPWSFALHIFLNCIEFQQILLVSRHLKESLRVKSNEKAQEKEVWRIPAMVLAEMIVGKMNRDLMLHEQRANRARNCKGLWCYIVPL

SEQ ID NO: 62 - protein, 230 aa, Colobus angolensis
PSTGDPTLRRRIEPWEFDIFYDPRELRKEACLLYEIKWGMSQKIWRSSGKNTTNHVEVNFIEKLTSERRFHSSVSCSITWFLSWSPCWECSQAIREFLSQHPGVTLVIYVARLFWHTDQQNRQGLRDLVNSGVTIQMMTASEYYHCWRNFVNYPPGEEAHWPRYPPLWMMLYALELHCIILSLPPCLKISRRWQNHLTFFRLHLQNCHYQTIPPHILLATGLIQPSVTWR

SEQ ID NO: 63 - protein, 139 aa, Tarsius syrichta
MGDPTLRRRIEPWEFEVLFDPRELRKEACLLYEIKWGTSCKIWRNSGKNTSNHAEVNFLEKFTSERHFCSSTSYSITWFLSWSPCWECSRAIREFLSQHPRVTLVIYVARLFWHMEPQNRQGLRDLINSGVTIQIMRDS

SEQ ID NO: 64 - protein, 236 aa, Sus scrofa
MASDRGPSAGDATSRRRIEPWEFEVFFDPRELRKETCLLYELQWGRSRDTWRHTGKNTTNHVERNFLAKITSERHFHPSVHCSIVWFLSWSPCWECSEAIREFLDQHPSVTLVIYVARLFQHMDPQNRQGLRDLVNHGVTIQIMGAPEYDYCWRNFVNYPPGKEAHWPRFPPVWMTLYALELHCIILGLPPCLKISRRCQNQLTFFRLTLQNCHYQTIPPHILLATGLIQLPVIYR

SEQ ID NO: 65 - protein, 236 aa, Macaca nemestrina
MTSEKGPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMRASEYYHCWRNFVNYLPGEEAHWPRYPPLWMMLYALELHCIILSLPPCLKISRRWQNHLTFFRLHLQNCHYQMIPPHILLATGLIQPSVTWR

SEQ ID NO: 66 - protein, 236 aa, Oryctolagus cuniculus
MASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSMAIREFLSQHPGVTLIIFVARLFQHMDRRNRQGLKDLVTSGVTVRVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 67 - protein, 229 aa, Rattus norvegicus [sequence omitted]

SEQ ID NO: 68 - protein, 142 aa, Cariama cristata
RWKIQPDDFKRNYLPGQHPEVVYLLYEIKWNSGTIWRNWCSNNPTQHAEVNFLENHFNVMSSVSCSITWGISTTPCGKCSRRILEFLTTHPNVTLEIYAAKLFKHLDIRNRQGLRNLAMNGVVICIMNLADYSYFWKTFVAY

SEQ ID NO: 69 - protein, 142 aa, Gavia stellata
RWKIQPNDFKRNYLPAQHPKVVYLLYEIRWSRGTIWRNWCSNNSTQHAEVNFLENCFKAMPSVSCSITWFLSTTPCGKCSRRILTFLREHPNVTLEIYAAKLFKHLDVRNQQGLRNLDRNGVIIRIMNFADYSYCWKRFVAY

SEQ ID NO: 70 - protein, 231 aa, Macaca mulatta; identical to SEQ ID NO: 26

SEQ ID NO: 71 - protein, 142 aa, Acanthisitta chloris
RWKIQPNDFQRNYLPDQHPQAVYLLYEFRWRRGSIWRKWCSNNRAQHAEVNFLENCFNGIPPVPCSITWFLSTTPCGNCSRRILEFLRLHPNVTLEIYAAKLFRHTDIRNRKGLYNLAMNGVIIRIMNLADYSYCWRNFVAY

SEQ ID NO: 72 - protein, 197 aa, Columba livia
MAAVTNRDSACRENNQRWKIQPNDFRRNYLPDKQPRVVYLLYEIRWRRGTIWRNWCSNNPNQHAEVNFLKNYFNAMPSVSCSITWVLSTTPCGKCSIKIMEFLKLHPNVTLEIYAAKLFKHLDIRNREGLRNLAKNGVIIHIMNLADYSYWWKIFVTRQHGEEDYLPWSFALHIFLNCIEFQQILLGLPPLLPNFKY

SEQ ID NO: 73 - protein, 239 aa, Ovis aries
MASDRGPPAGDPTLRRRIEPLEFEFSFDPRNFCKEAYLLYEIQWGNSRDVWRHSGKNTTKHVERNFIEKIASERHFRPSISCSISWYLSWSPCWECSKAIREFLNQHPNVTLVIYIARLFQHMDPQNRQGLKDLFHSGVTIQVMRDPEYDYCWRNFVNYPQGKEAHWPRYPPLWMNLYALELYCIISGLPPCLQISRRHQNQLRVFRLIPQNCHYQMIPPCILLATGMIQLPVTWRWIE

SEQ ID NO: 74 - protein, 236 aa, Otolemur garnettii
ISWSTGISTGDPTLRRRIEPWEFEVFFDPRELRKETCLLYEIKWGTSHKIWRSTARNTTSHAEMNFIEKFTSERCSDAPISCSITWFLSWSPCWECSKAIREFVSRHPSVTLVIYVARLYWHMDQQNRQGLRDLISSGVTVQIMRVSEYCHCWRNFVNYLPGKEAHCPRCPPLWMTLYALELHCIILSLPPCLKISRGHQNQLTLFRLTLQNCHYQTIPPHVLLATGLIQPYVTWR

SEQ ID NO: 75 - protein, 205 aa, Stylophora pistillata
MASVTELRTPDDFLAELLWTGVTGRTWPNRTFLIVSIKAKDGKPIFGKRFKNRYPEHAEIIMLRNSNFSDVVEKNHDIDITLTLNYSPCSSCACILKEFYVNNSNIKCFTIQFSFIYYKEDMKNKTGLQNLEEAGVTLQAMNAESWREVGIDLESFTPEDKEKINKRDKDTANDLNEVLSSKQDQDASVDELSSQLNAKLRAKET

SEQ ID NO: 76 - protein, 248 aa, Cercocebus atys
MTPEEEVQRQSTMTSEKGPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMRASEYYHCWRNFVNYPPGEEAHWPRYPPLWMMLYALELHCIILSLPPCLKISRRQQNHLTFFRLHLQNCHYQTIPPHILLATGLIQPSVTWR

SEQ ID NO: 77 - protein, 238 aa, Physeter macrocephalus
MIICWSTGPSAGDATSRRRIEPWEFEVSFDPREFCKEARLLYEIKWGKSQDVWRHSGKNTTKHVECNFIEKMTSERHFHPSISCCIIWFLSWSPCWECSKAIREFLNQHPSVTLVIYIARLFQHTDPQNRQGLRDLIHSGVTLQIMGPPEYDYCWRNFVNYPPGKEAHWPRYPPLWMKLYALELHCIILGLPPCLKISRRCQNQLTWFRLILQNCHYQMIPPHILLGTGLIQLPVAWR

SEQ ID NO: 78 - protein, 248 aa, Pongo abelii
MTPEEEVQRQSTMTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWK

SEQ ID NO: 79 - protein, 142 aa, Eurypyga helias
RWKIQPNDFKRNYMPSQYPKVVYLLYEIRWSRGTVWRNWCSNSFTQHAEVNFLENYFKPMPSVSCSITWVLSTTPCGKCSRRILEFLRVHPNVTLEIYAAKLFKHLDIRNRQGLRDLAMNGVTIRIMNLADYSFCWKRFVAY

SEQ ID NO: 80 - protein, 228 aa, Sarcophilus harrisii
MGDATLRRRIKSWEFEAFFNPQELRKETCLLYEIKWGASHNIWRSSNQNTTQHAEINFMEKFTSERNFKPSVKCSITWFLSWSPCWRCSKAIREFLNQYPNVTLVIFVSRLYWHMEQQHRQELKELVCSGVTIQIMNYSEYRHCWRNFVDYLPEEEDHWPKYPTLWIMLYVLELHCIILGLPPCLKISVRHSDQLVLFSLDLQDCHYQKIPYHVLVATGIIRPFVTWR

SEQ ID NO: 81 - protein, 338 aa, Leptonychotes weddellii
MASDKGPSAGDATLRRRIKPWEFEVFFDPRELRKETCLLYEIQWGTSHKIWRNSGKNTANHVEINFIEKFTSERQYCPSIRCSITWFLSWSPCWECSKAIRGFLSQHPSVTLVIYVARLFWHMDPQNRQGLRDLINSGVTIQIMRVPEYDHCWRNFVNYLPGKEDHWPRYPVLWMKLYALELHCIILPIEMPGKIRDAPNNMEIFSLFVGRYIPKTKFHVTCLLSDVRNDDSHLDKTAPKWIRFDSLQPVASDPSAEHWKMKLPGRDDKTAVVVGTVTEDVACAQGAKLYLCALRVHGHAQRHFLKGRDEILALDQLALDSPQGLWRQPDLRSHPLKG

SEQ ID NO: 82 - protein, 216 aa, Erinaceus europaeus
RRIEPWEFEDFFDPRQFRPETCLLYEVRWGSSRNAWRSTARNTTRHAEVNFLERFAAERHFDKPVSCSITWFLSWSPCWECSQAIGAFLSQHPQVTLAIHVTRLFHHEDEQNRQGLRDLLARGVTLQVMGDSEYAHCWRTFVNSPPGAEGHYPRYPSDFTRLYALELHCIILGLPPCLEILRRYQNQFTLFRLVPQNCHYQMIPHLNFFVVRHYFF

SEQ ID NO: 83 - protein, 142 aa, Haliaeetus albicilla
RWKLQPNDFKRNYLPGQHPKVVYLLYEIRWSRGTIWRNWCSNNSTQHAEVNFLENCFKATPSVSCSITWVLSTTPCGKCSRRILEFLRVHPNVTLEIYAAKLFKHLDIRNRKGLRDLAMNGVIIRIMNLSDYSYCWKTFVAY

SEQ ID NO: 84 - protein, 221 aa, Callithrix jacchus
RRIEPWEFYISYDPKELCKETCLLYEIKWGMSWKIWRSSGKNTTNHVEINFIEKFTSERHFHLSVSCSITWFLSWSPCWECSQAIREFLSQHPGVTLVIYVARLFQHMDQQNRQGLRDLVNSGVTIQMMTVSEYYHCWRNFVNYPPGEEAHWPRHPPLWLMLYALELHCIILGLPPCLKISRRRQNRLTFFRLHLQNCHYQMIPRHILLATGLIQPSVTWR

SEQ ID NO: 85 - protein, 238 aa, Bos mutus
MIISWSTGPPAGDPTLRRRIEPWEFEFSFDPRKFCKEACLLYEIQWGNNRDVWRHSGKNTTKHVERNFIEKIASERYFCPSIRCFIFWYLSWSPCWECSKAIREFLNQHPNVTLVIYIARLFQHMDPQNRQGLKDLVQSGVTIQVMRAPEYEYCWRNFVNYPRGKEAHWPRYPPLWMNLYALELYCIILGLPPCLHISRRYQNQLIVFRLTLQNCHYQMIPPYILLATGMVQIPMTWR

SEQ ID NO: 86 - protein, 130 aa, Pterocles gutturalis
RWKIQPNYFKINNLPGQHPRVVCLLYAIRWSRSTLWKSWCSNNSTQHAEVNFLENCFKGNPSVFCFMTWPFFHTTPHGKCCRRTPEFLGVHPNVTLKIRAAKLFKHLDRYNQQGLRNVAMNGVVIRIINL

SEQ ID NO: 87 - protein, 198 aa, Homo sapiens [sequence omitted]

SEQ ID NO: 88 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 89 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 90 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 91 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 92 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 93 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 94 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 95 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPEFADCWENFVDHEKPLSFNPYKMLEELDKNSRAIKRRLERIKIPGVRAQGRYMDILCDAEV

SEQ ID NO: 96 - skipped

SEQ ID NO: 97 - protein, 229 aa, Mus musculus; identical to SEQ ID NO: 52

SEQ ID NO: 98 - protein, 236 aa, Pan troglodytes; identical to SEQ ID NO: 21

SEQ ID NO: 99 - protein, 236 aa, Canis lupus; identical to SEQ ID NO: 31

SEQ ID NO: 100 - protein, 236 aa, Homo sapiens; identical to SEQ ID NO: 48

SEQ ID NO: 101 - protein, 236 aa, Bos taurus; identical to SEQ ID NO: 17

SEQ ID NO: 102 - protein, 236 aa, Macaca mulatta
MTSEKGPSTGDPTLRRRIEPWEFDIFYDPRELRKEACLLYEIKWGMSPKIWRSSGKNTTNHVEVNFIEKLTSERRFHSSISCSITWFLSWSPCWECSQAIREFLSQHPGVTLVIYVARLFWHTDQQNRQGLRDLVNSGVTIQIMRASEYYHCWRNFVNYPPGEEAHWPRYPPLWMMLYALELHCIILSLPPCLKISRRWQNHLTFFRLHLQNCHYQMIPPHILLATGLIQPSVTWR

SEQ ID NO: 103 - DNA, 21 bp, Artificial Sequence
  Description of Artificial Sequence: Synthetic oligonucleotide
ggagacgattaatgcgtctcc

SEQ ID NO: 104 - DNA, 20 bp, Artificial Sequence
  Description of Artificial Sequence: Synthetic oligonucleotide
gtcatcttagtcattacctg

SEQ ID NO: 105 - DNA, 20 bp, Artificial Sequence
  Description of Artificial Sequence: Synthetic oligonucleotide
gagtccgagcagaagaagaa

SEQ ID NO: 106 - DNA, 20 bp, Artificial Sequence
  Description of Artificial Sequence: Synthetic oligonucleotide
gtattcacctgaaagtgtgc

SEQ ID NO: 107 - DNA, 20 bp, Artificial Sequence
  Description of Artificial Sequence: Synthetic oligonucleotide
ggaatcccttctgcagcacc

SEQ ID NO: 108 - DNA, 20 bp, Artificial Sequence
  Description of Artificial Sequence: Synthetic oligonucleotide
gaacacaaagcatagactgc

SEQ ID NO: 109 - DNA, 20 bp, Artificial Sequence
  Description of Artificial Sequence: Synthetic oligonucleotide
ggcccagactgagcacgtga

SEQ ID NO: 110 - DNA, 20 bp, Artificial Sequence
  Description of Artificial Sequence: Synthetic oligonucleotide
ggcactgcggctggaggtgg

SEQ ID NO: 111 - DNA, 20 bp, Artificial Sequence
  Description of Artificial Sequence: Synthetic oligonucleotide
gactcacccaggagtgcgtt

SEQ ID NO: 112 - DNA, 20 bp, Artificial Sequence
  Description of Artificial Sequence: Synthetic oligonucleotide
ggcactcgggggcgagagga

SEQ ID NO: 113 - DNA, 20 bp, Artificial Sequence
  Description of Artificial Sequence: Synthetic oligonucleotide
gagctcactgaacgctggca

SEQ ID NO: 114 - DNA, 19 bp, Artificial Sequence
  Description of Artificial Sequence: Synthetic oligonucleotide
cgtgacttccacatgagcg

SEQ ID NO: 115 - DNA, 20 bp, Artificial Sequence
  Description of Artificial Sequence: Synthetic oligonucleotide
gaccccctccaccccgcctc

SEQ ID NO: 116 - protein, 1623 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 117 - protein, 1710 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 118 - protein, 1710 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 119 - protein, 1689 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 120 - protein, 1679 aa, Artificial Sequence
  Description of Artificial Sequence: Synthetic polypeptide
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 121 - protein, 1899 aa, Artificial Sequence
  Description of Artificial Sequence: Synthetic polypeptide
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 122 - protein, 1618 aa, Artificial Sequence
  Description of Artificial Sequence: Synthetic polypeptide
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGGSPKKKRKVSSDYKDHDGDYKDHDIDYKDDDDKSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 123 - protein, 1824 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 124 - protein, 2013 aa, Artificial Sequence
  Description of Artificial Sequence: Synthetic polypeptide
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 125 - protein, 1544 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGGSPKKKRKVSSDYKDHDGDYKDHDIDYKDDDDKSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 126 - protein, 1733 aa, Artificial Sequence
  Description of Artificial Sequence: Synthetic polypeptide
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGGSPKKKRKVSSDYKDHDGDYKDHDIDYKDDDDKSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 127 - protein, 1853 aa, Artificial Sequence
  Description of Artificial Sequence: Synthetic polypeptide
  MOD_RES (20)..(247): This region may encompass one of the following sequences: "[sequence omitted] [sequence omitted] [sequence omitted]
  MOD_RES (20)..(247): CONT. FROM ABOVE: [sequence omitted] GLK" or "SSETGPVAVDPTLRRRIEPHEFEVFFDPRELRKETCLLYEIKWGTSHKIWRH SSKNTTKHVEVNFIEKFTSERHFCPSTSCSITWFLSWSPCGECSKAITEFLSQHPNVTLVI YVARLYHHMDQQNRQGLRDLVNSGVTIQIMTAPEYDYCWRNFVNYPPGKEAHWPRYPPLWM
  MOD_RES (20)..(247): CONT. FROM ABOVE: KLYALELHAGILGLPPCLNILRRKQPQLTFFTIALQSCHYQRL PPHILWATGLK" or "SSETGPVAVDPTLRRRIEPHEFEVFFDPRELRKEACLLYEIKWG TSHKIWRNSGKNTTKHVEVNFIEKFTSERHFCPSISCSITWFLSWSPCWECSKAIREFLSQ HPNVTLVIYVARLFQHMDQQNRQGLRDLVNSGVTIQIMTASEYDHCWRNFVNYPPGKEAHW
  MOD_RES (20)..(247): CONT. FROM ABOVE: PRYPPLWMKLYALELHAGILGLPPCLNILRRKQPQLTFFTIAL [sequence omitted]" or "SSETGPVAVDPTLRRRIEPEFFNRNYDPRELRKETY LLYEIKWGKESKIWRHTSNNRTQHAEVNFLENFFNELYFNPSTHCSITWFLSWSPCGECSK AIVEFLKEHPNVNLEIYVARLYLCEDERNRQGLRDLVNSGVTIRIMNLPDYNYCWRTFVSH
  MOD_RES (20)..(247): CONT. FROM ABOVE: QGGDEDYWPRHFAPWVRLYVLELYCIILGLPPCLNILRRKQPQ [sequence omitted]" or "SSETGPVAVDPTLRRRIEPFYFQFNNDP RACRRKTYLCYELKQDGSTWVWKRTLHNKGRHAEICFLEKISSLEKLDPAQHYRITWYMSW SPCSNCAQKIVDFLKEHPHVNLRIYVARLYYHEEERYQEGLRNLRRSGVSIRVMDLPDFEH
  MOD_RES (20)..(247): CONT. FROM ABOVE: CWETFVDNGGGPFQPWPGLEELNSKQLSRRLQAGILGLPPCLN [sequence omitted]" or "SSETGPVAVDPTLRRRIEPF HFQFNNDPRAYRRKTYLCYELKQDGSTWVLDRTLRNKGRHAEICFLDKINSWERLDPAQHY RVTWYMSWSPCSNCAQQVVDFLKEHPHVNLRIFAARLYYHEQRRYQEGLRSLRGSGVPVAV
  MOD_RES (20)..(247): CONT. FROM ABOVE: MTLPDFEHCWETFVDHGGRPFQPWDGLEELNSRSLSRRLQAGI [sequence omitted]"
  See specification as filed for detailed description of substitutions and preferred embodiments
MKRTADGSEFESPKKKRKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKV

SEQ ID NO: 128 - protein, 228 aa, Artificial Sequence
  Description of Artificial Sequence: Synthetic polypeptide
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 129 - protein, 228 aa, Artificial Sequence
  Description of Artificial Sequence: Synthetic polypeptide
SSETGPVAVDPTLRRRIEPHEFEVFFDPRELRKETCLLYEIKWGTSHKIWRHSSKNTTKHVEVNFIEKFTSERHFCPSTSCSITWFLSWSPCGECSKAITEFLSQHPNVTLVIYVARLYHHMDQQNRQGLRDLVNSGVTIQIMTAPEYDYCWRNFVNYPPGKEAHWPRYPPLWMKLYALELHAGILGLPPCLNILRRKQPQLTFFTIALQSCHYQRLPPHILWATGLK

SEQ ID NO: 130 - protein, 228 aa, Artificial Sequence
  Description of Artificial Sequence: Synthetic polypeptide
SSETGPVAVDPTLRRRIEPHEFEVFFDPRELRKEACLLYEIKWGTSHKIWRNSGKNTTKHVEVNFIEKFTSERHFCPSISCSITWFLSWSPCWECSKAIREFLSQHPNVTLVIYVARLFQHMDQQNRQGLRDLVNSGVTIQIMTASEYDHCWRNFVNYPPGKEAHWPRYPPLWMKLYALELHAGILGLPPCLNILRRKQPQLTFFTIALQSCHYQRLPPHILWATGLK

SEQ ID NO: 131 - protein, 228 aa, Artificial Sequence
  Description of Artificial Sequence: Synthetic polypeptide
SSETGPVAVDPTLRRRIEPEFFNRNYDPRELRKETYLLYEIKWGKESKIWRHTSNNRTQHAEVNFLENFFNELYFNPSTHCSITWFLSWSPCGECSKAIVEFLKEHPNVNLEIYVARLYLCEDERNRQGLRDLVNSGVTIRIMNLPDYNYCWRTFVSHQGGDEDYWPRHFAPWVRLYVLELYCIILGLPPCLNILRRKQPQLTFFTIALQSCHYQRLPPHILWATGLK

SEQ ID NO: 132 - protein, 228 aa, Artificial Sequence
  Description of Artificial Sequence: Synthetic polypeptide
SSETGPVAVDPTLRRRIEPFYFQFNNDPRACRRKTYLCYELKQDGSTWVWKRTLHNKGRHAEICFLEKISSLEKLDPAQHYRITWYMSWSPCSNCAQKIVDFLKEHPHVNLRIYVARLYYHEEERYQEGLRNLRRSGVSIRVMDLPDFEHCWETFVDNGGGPFQPWPGLEELNSKQLSRRLQAGILGLPPCLNILRRKQPQLTFFTIALQSCHYQRLPPHILWATGLK

SEQ ID NO: 133 - protein, 228 aa, Artificial Sequence
  Description of Artificial Sequence: Synthetic polypeptide
SSETGPVAVDPTLRRRIEPFHFQFNNDPRAYRRKTYLCYELKQDGSTWVLDRTLRNKGRHAEICFLDKINSWERLDPAQHYRVTWYMSWSPCSNCAQQVVDFLKEHPHVNLRIFAARLYYHEQRRYQEGLRSLRGSGVPVAVMTLPDFEHCWETFVDHGGRPFQPWDGLEELNSRSLSRRLQAGILGLPPCLNILRRKQPQLTFFTIALQSCHYQRLPPHILWATGLK

SEQ ID NO: 134 - protein, 83 aa, Bacillus phage PBS2
TNLSDIIEKETGKQLVIQESILMLPEEVEEVIGNKPESDILVHTAYDESTDENVMLLTSDAPEYKPWALVIQDSNGENKIKML

SEQ ID NO: 135 - protein, 4 aa, Artificial Sequence
  Description of Artificial Sequence: Synthetic peptide
GGGS

SEQ ID NO: 136 - protein, 5 aa, Artificial Sequence
  Description of Artificial Sequence: Synthetic peptide
GGGGS

SEQ ID NO: 137 - protein, 7 aa, Artificial Sequence
  Description of Artificial Sequence: Synthetic peptide
PKKKRRV

SEQ ID NO: 138 - protein, 16 aa, Artificial Sequence
  Description of Artificial Sequence: Synthetic peptide
KRPAATKKAGQAKKKK

SEQ ID NO: 139 - skipped

SEQ ID NO: 140 - DNA, 104 bp, Artificial Sequence
  Description of Artificial Sequence: Synthetic polynucleotide
  modified_base (1)..(20): a, c, t, g, unknown or other
nnnnnnnnnnnnnnnnnnnncgttttagagctagaaatagcaagttaaaataaggctagtccgttatcaacttgaaaaagtggcaccgagtcggtgcttttttt

SEQ ID NO: 141 - DNA, 20 bp, Artificial Sequence
  Description of Artificial Sequence: Synthetic oligonucleotide
  modified_base (1)..(20): a, c, t, g, unknown or other
nnnnnnnnnnnnnnnnnnnn

SEQ ID NO: 142 - DNA, 483 bp, Artificial Sequence
  Description of Artificial Sequence: Synthetic polynucleotide
tttgagaggaactacgacccccgggagctggccaaggagacatacctgctgtatgagatcaagtggggcaagtccggcaagctgtggaggcactggtgccagaacaatcgcacacagcacgccgaggtgtacttcctggagaacatctttaatgcccggagattcaatccatctacccactgtagcatcacatggtatctgagctggtccccctgcgccgagtgttctcagaagatcgtggatttcctgaaggagcaccctaacgtgaatctggagatctatgtggcccggctgtactatccagagaacgagaggaataggcagggcctgcgggatctggtgaattccggcgtgaccatcagaatcatggacctgccagattacaactattgctggaagaccttcgtgagcgatcagggaggcgacgaggattactggccaggacacttcgccccttggatcaagcagtatagcctgaagctg

SEQ ID NO: 143 - protein, 161 aa, Artificial Sequence
  Description of Artificial Sequence: Synthetic polypeptide
FERNYDPRELAKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 144 - DNA, 483 bp, Artificial Sequence
  Description of Artificial Sequence: Synthetic polynucleotide
tttgagaggaactacgacccccgggagctggccgccgagacatacctgctgtatgagatcaagtggggcaagtccggcaagctgtggaggcactggtgccagaacaatcgcacacagcacgccgaggtgtacttcctggagaacatctttaatgcccggagattcaatccatctacccactgtagcatcacatggtatctgagctggtccccctgcgccgagtgttctcagaagatcgtggatttcctgaaggagcaccctaacgtgaatctggagatctatgtggcccggctgtactatccagagaacgagaggaataggcagggcctgcgggatctggtgaattccggcgtgaccatcagaatcatggacctgccagattacaactattgctggaagaccttcgtgagcgatcagggaggcgacgaggattactggccaggacacttcgccccttggatcaagcagtatagcctgaagctg

SEQ ID NO: 145 - protein, 161 aa, Artificial Sequence
  Description of Artificial Sequence: Synthetic polypeptide
FERNYDPRELAAETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 146 - protein, 6 aa, Artificial Sequence
  Description of Artificial Sequence: Synthetic 6xHis tag
HHHHHH

SEQ ID NO: 147 - DNA, 23 bp, Artificial Sequence
  Description of Artificial Sequence: Synthetic oligonucleotide
tttytttttttttttttttgagg

SEQ ID NO: 148 - DNA, 23 bp, Artificial Sequence
  Description of Artificial Sequence: Synthetic oligonucleotide
tttgyggtggagaggggcttcgg

SEQ ID NO: 149 - DNA, 23 bp, Artificial Sequence
  Description of Artificial Sequence: Synthetic oligonucleotide
ttgyggtggagaggggcttcggg

SEQ ID NO: 150 - DNA, 23 bp, Artificial Sequence
  Description of Artificial Sequence: Synthetic oligonucleotide
ttgytaataaaagttagaaacgg

SEQ ID NO: 151 - DNA, 23 bp, Artificial Sequence
  Description of Artificial Sequence: Synthetic oligonucleotide
ttgayagggagcaagcagttcgg

SEQ ID NO: 152 - DNA, 23 bp, Artificial Sequence
  Description of Artificial Sequence: Synthetic oligonucleotide
tgayagggagcaagcagttcggg

SEQ ID NO: 153 - DNA, 23 bp, Artificial Sequence
  Description of Artificial Sequence: Synthetic oligonucleotide
ttcygtaaaacataaaagtcagg

SEQ ID NO: 154 - DNA, 23 bp, Artificial Sequence
  Description of Artificial Sequence: Synthetic oligonucleotide
ttcyggtttgtcttatattctgg

SEQ ID NO: 155 - DNA, 23 bp, Artificial Sequence
  Description of Artificial Sequence: Synthetic oligonucleotide
cttcyatgatcttcgaggagagg

SEQ ID NO: 156 - DNA, 23 bp, Artificial Sequence
  Description of Artificial Sequence: Synthetic oligonucleotide
ttcyatgatcttcgaggagaggg

SEQ ID NO: 157 - DNA, 23 bp, Artificial Sequence
  Description of Artificial Sequence: Synthetic oligonucleotide
ttcgtggyggaagctcctcacgg

SEQ ID NO: 158 - DNA, 23 bp, Artificial Sequence
  Description of Artificial Sequence: Synthetic oligonucleotide
cttcaytgtggtcattttcctgg

SEQ ID NO: 159 - DNA, 23 bp, Artificial Sequence
  Description of Artificial Sequence: Synthetic oligonucleotide
ttcaytgtggtcattttcctggg

SEQ ID NO: 160 - DNA, 23 bp, Artificial Sequence
  Description of Artificial Sequence: Synthetic oligonucleotide
ttcagygtattgctttgaggagg

SEQ ID NO: 161 - DNA, 23 bp, Artificial Sequence
  Description of Artificial Sequence: Synthetic oligonucleotide
ttaagttytatgcgattaccggg

SEQ ID NO: 162 - DNA, 23 bp, Artificial Sequence
  Description of Artificial Sequence: Synthetic oligonucleotide
tgtgttygcgcagggagctcggg

SEQ ID NO: 163 - DNA, 23 bp, Artificial Sequence
  Description of Artificial Sequence: Synthetic oligonucleotide
atgtgttygcgcagggagctcgg

SEQ ID NO: 164 - DNA, 23 bp, Artificial Sequence
  Description of Artificial Sequence: Synthetic oligonucleotide
tgtggyggccatggcctatgagg

SEQ ID NO: 165 - DNA, 23 bp, Artificial Sequence
  Description of Artificial Sequence: Synthetic oligonucleotide
tgtgayggacagagcacaaatgg

SEQ ID NO: 166 - DNA, 23 bp, Artificial Sequence
  Description of Artificial Sequence: Synthetic oligonucleotide
tgtagyaggtgaagatgatcagg

SEQ ID NO: 167 - DNA, 23 bp, Artificial Sequence
  Description of Artificial Sequence: Synthetic oligonucleotide
tgtaatayttctgatcatgttgg

SEQ ID NO: 168 - DNA, 23 bp, Artificial Sequence
  Description of Artificial Sequence: Synthetic oligonucleotide
tggyagaggcccctggggtcagg

SEQ ID NO: 169 - DNA, 23 bp, Artificial Sequence
  Description of Artificial Sequence: Synthetic oligonucleotide
tggyaagttctcccctcaacagg

SEQ ID NO: 170 - DNA, 23 bp, Artificial Sequence
  Description of Artificial Sequence: Synthetic oligonucleotide
tggttyggcatcatagtgctggg

SEQ ID NO: 171 - DNA, 23 bp, Artificial Sequence
  Description of Artificial Sequence: Synthetic oligonucleotide
gtggttyggcatcatagtgctgg

SEQ ID NO: 172 - DNA, 23 bp, Artificial Sequence
  Description of Artificial Sequence: Synthetic oligonucleotide
tggggaayatacgtgcttggcgg

SEQ ID NO: 173 - DNA, 23 bp, Artificial Sequence
  Description of Artificial Sequence: Synthetic oligonucleotide
ggggaayatacgtgcttggcggg

SEQ ID NO: 174 - DNA, 23 bp, Artificial Sequence
  Description of Artificial Sequence: Synthetic oligonucleotide
gagtygcaccaaaatttttgggg

SEQ ID NO: 175 - DNA, 23 bp, Artificial Sequence
  Description of Artificial Sequence: Synthetic oligonucleotide
ggagtygcaccaaaatttttggg

SEQ ID NO: 176 - DNA, 23 bp, Artificial Sequence
  Description of Artificial Sequence: Synthetic oligonucleotide
tggagtygcaccaaaatttttgg

SEQ ID NO: 177 - DNA, 23 bp, Artificial Sequence
  Description of Artificial Sequence: Synthetic oligonucleotide
tggaagytatcgatgaccacagg

SEQ ID NO: 178 - DNA, 23 bp, Artificial Sequence
  Description of Artificial Sequence: Synthetic oligonucleotide
tgcyggtggccgacgtgaagcgg

SEQ ID NO: 179 - DNA, 23 bp, Artificial Sequence
  Description of Artificial Sequence: Synthetic oligonucleotide
tgcyaaaagacccaaaacaaagg

SEQ ID NO: 180 - DNA, 23 bp, Artificial Sequence
  Description of Artificial Sequence: Synthetic oligonucleotide
tgctygatccactggatgtgggg

SEQ ID NO: 181 - DNA, 23 bp, Artificial Sequence
  Description of Artificial Sequence: Synthetic oligonucleotide
gtgctygatccactggatgtggg

SEQ ID NO: 182 - DNA, 23 bp, Artificial Sequence
  Description of Artificial Sequence: Synthetic oligonucleotide
cgtgctygatccactggatgtgg

SEQ ID NO: 183 - DNA, 23 bp, Artificial Sequence
  Description of Artificial Sequence: Synthetic oligonucleotide
tgctgaytggaaaccgtgagtgg

SEQ ID NO: 184 - DNA, 23 bp, Artificial Sequence
  Description of Artificial Sequence: Synthetic oligonucleotide
gtgcggyatttgtcctgctccgg

SEQ ID NO: 185 - DNA, 23 bp, Artificial Sequence
  Description of Artificial Sequence: Synthetic oligonucleotide
tgcggyatttgtcctgctccggg

SEQ ID NO: 186 - DNA, 23 bp, Artificial Sequence
  Description of Artificial Sequence: Synthetic oligonucleotide
tgcggagyggacgggcagcgtgg

SEQ ID NO: 187 - DNA, 23 bp, Artificial Sequence
  Description of Artificial Sequence: Synthetic oligonucleotide
gcgaytgcagaagatgacctggg

SEQ ID NO: 188 - DNA, 23 bp, Artificial Sequence
  Description of Artificial Sequence: Synthetic oligonucleotide
tgcgaytgcagaagatgacctgg

SEQ ID NO: 189 - DNA, 23 bp, Artificial Sequence
  Description of Artificial Sequence: Synthetic oligonucleotide
gcayggtctctcgggcgctgggg

SEQ ID NO: 190 - DNA, 23 bp, Artificial Sequence
  Description of Artificial Sequence: Synthetic oligonucleotide
tgcayggtctctcgggcgctggg

SEQ ID NO: 191 - DNA, 23 bp, Artificial Sequence
  Description of Artificial Sequence: Synthetic oligonucleotide
ctgcayggtctctcgggcgctgg

SEQ ID NO: 192 - DNA, 23 bp, Artificial Sequence
  Description of Artificial Sequence: Synthetic oligonucleotide
tgcagyagccgcccttctgccgg

SEQ ID NO: 193 - DNA, 23 bp, Artificial Sequence
  Description of Artificial Sequence: Synthetic oligonucleotide
tgayggaggggatggcgcctagg

SEQ ID NO: 194 - DNA, 23 bp, Artificial Sequence
  Description of Artificial Sequence: Synthetic oligonucleotide
tgatgygaggctgccgccgcagg

SEQ ID NO: 195 - DNA, 23 bp, Artificial Sequence
  Description of Artificial Sequence: Synthetic oligonucleotide
tgagyatgcataagcgacgaagg

SEQ ID NO: 196 - DNA, 23 bp, Artificial Sequence
  Description of Artificial Sequence: Synthetic oligonucleotide
tgagtytgagagccggctggcgg

SEQ ID NO: 197 - DNA, 23 bp, Artificial Sequence
  Description of Artificial Sequence: Synthetic oligonucleotide
tgagtaygcataagcgacgaagg

SEQ ID NO: 198 - DNA, 23 bp, Artificial Sequence
  Description of Artificial Sequence: Synthetic oligonucleotide
tgaggyaatcagccaggatctgg

SEQ ID NO: 199 - DNA, 23 bp, Artificial Sequence
  Description of Artificial Sequence: Synthetic oligonucleotide
tgagayggcccacctgggcttgg

SEQ ID NO: 200 - DNA, 23 bp, Artificial Sequence
  Description of Artificial Sequence: Synthetic oligonucleotide
gagayggcccacctgggcttggg

SEQ ID NO: 201 - DNA, 23 bp, Artificial Sequence
  Description of Artificial Sequence: Synthetic oligonucleotide
tctyggagggcgaggaggagagg

SEQ ID NO: 202 - DNA, 23 bp, Artificial Sequence
  Description of Artificial Sequence: Synthetic oligonucleotide
tctygatggccacgtcgtactgg

SEQ ID NO: 203 - DNA, 23 bp, Artificial Sequence
  Description of Artificial Sequence: Synthetic oligonucleotide
tctttaytgtttaagccaacagg

SEQ ID NO: 204 - DNA, 23 bp, Artificial Sequence
  Description of Artificial Sequence: Synthetic oligonucleotide
tctgyggaccaaaatcattctgg

SEQ ID NO: 205 - DNA, 23 bp, Artificial Sequence
  Description of Artificial Sequence: Synthetic oligonucleotide
tctggytgatactcaagtccagg

SEQ ID NO: 206 - DNA, 23 bp, Artificial Sequence
  Description of Artificial Sequence: Synthetic oligonucleotide
tccyagtaagaaacagaatatgg

SEQ ID NO: 207 - DNA, 23 bp, Artificial Sequence
  Description of Artificial Sequence: Synthetic oligonucleotide
tccyaaaaggcacgggatgaagg

SEQ ID NO: 208 - DNA, 23 bp, Artificial Sequence
  Description of Artificial Sequence: Synthetic oligonucleotide
tccaytgtggcccaggaaggagg

SEQ ID NO: 209 - DNA, 23 bp, Artificial Sequence
  Description of Artificial Sequence: Synthetic oligonucleotide
cgctccaytgtggcccaggaagg

SEQ ID NO: 210 - DNA, 23 bp, Artificial Sequence
  Description of Artificial Sequence: Synthetic oligonucleotide
tccayggtcaagtcagcctcagg

SEQ ID NO: 211 - DNA, 23 bp, Artificial Sequence
  Description of Artificial Sequence: Synthetic oligonucleotide
ccayggtcaagtcagcctcaggg

SEQ ID NO: 212 - DNA, 23 bp, Artificial Sequence
  Description of Artificial Sequence: Synthetic oligonucleotide
ctccayggagttccctggcctgg

SEQ ID NO: 213 - DNA, 23 bp, Artificial Sequence
  Description of Artificial Sequence: Synthetic oligonucleotide
tccayggagttccctggcctggg

SEQ ID NO: 214 - DNA, 23 bp, Artificial Sequence
  Description of Artificial Sequence: Synthetic oligonucleotide
ccayggagttccctggcctgggg

SEQ ID NO: 215 - DNA, 23 bp, Artificial Sequence
  Description of Artificial Sequence: Synthetic oligonucleotide
tccayagatgaagttattgcagg

SEQ ID NO: 216 - DNA, 23 bp, Artificial Sequence
  Description of Artificial Sequence: Synthetic oligonucleotide
ctccagyaagttataaaatttgg

SEQ ID NO: 217 - DNA, 23 bp, Artificial Sequence
  Description of Artificial Sequence: Synthetic oligonucleotide
tccagyaagttataaaatttggg

SEQ ID NO: 218 - DNA, 23 bp, Artificial Sequence
  Description of Artificial Sequence: Synthetic oligonucleotide
tccaggygcgggcgtcatgctgg

SEQ ID NO: 219 - DNA, 23 bp, Artificial Sequence
  Description of Artificial Sequence: Synthetic oligonucleotide
ccaggygcgggcgtcatgctggg

SEQ ID NO: 220 - DNA, 23 bp, Artificial Sequence
  Description of Artificial Sequence: Synthetic oligonucleotide
tcaytgataagcagggcccaggg

SEQ ID NO: 221 - DNA, 23 bp, Artificial Sequence
  Description of Artificial Sequence: Synthetic oligonucleotide
ttcaytgataagcagggcccagg

SEQ ID NO: 222 - DNA, 23 bp, Artificial Sequence
  Description of Artificial Sequence: Synthetic oligonucleotide
tcayggtgagttaaggacagtgg

SEQ ID NO: 223 - DNA, 23 bp, Artificial Sequence
  Description of Artificial Sequence: Synthetic oligonucleotide
tcatattyacaggcttgtaaagg

SEQ ID NO: 224 - DNA, 23 bp, Artificial Sequence
  Description of Artificial Sequence: Synthetic oligonucleotide
catagtyctgcagaggagagggg

SEQ ID NO: 225 - DNA, 23 bp, Artificial Sequence
  Description of Artificial Sequence: Synthetic oligonucleotide
tcatagtyctgcagaggagaggg

SEQ ID NO: 226 - DNA, 23 bp, Artificial Sequence
  Description of Artificial Sequence: Synthetic oligonucleotide
tcagaagyttttttcttcgcagg

SEQ ID NO: 227 - DNA, 23 bp, Artificial Sequence
  Description of Artificial Sequence: Synthetic oligonucleotide
tcaagtgygtccttccggagcgg

SEQ ID NO: 228 - DNA, 23 bp, Artificial Sequence
  Description of Artificial Sequence: Synthetic oligonucleotide
caagtgygtccttccggagcggg

SEQ ID NO: 229 - DNA, 23 bp, Artificial Sequence
  Description of Artificial Sequence: Synthetic oligonucleotide
aagtgygtccttccggagcgggg

SEQ ID NO: 230 - DNA, 23 bp, Artificial Sequence
  Description of Artificial Sequence: Synthetic oligonucleotide
agtgygtccttccggagcggggg

SEQ ID NO: 231 - DNA, 23 bp, Artificial Sequence
  Description of Artificial Sequence: Synthetic oligonucleotide
tacygtgggcagagaaggggagg

SEQ ID NO: 232 - DNA, 23 bp, Artificial Sequence
  Description of Artificial Sequence: Synthetic oligonucleotide
aggtacygtgggcagagaagggg

SEQ ID NO: 233 - DNA, 23 bp, Artificial Sequence
  Description of Artificial Sequence: Synthetic oligonucleotide
caggtacygtgggcagagaaggg

SEQ ID NO: 234 - DNA, 23 bp, Artificial Sequence
  Description of Artificial Sequence: Synthetic oligonucleotide
taaytgtgcccatggccatttgg

SEQ ID NO: 235 - DNA, 23 bp, Artificial Sequence
  Description of Artificial Sequence: Synthetic oligonucleotide
taaatgaytgagtttgcccttgg

SEQ ID NO: 236 - DNA, 23 bp, Artificial Sequence
  Description of Artificial Sequence: Synthetic oligonucleotide
gttataygtgccaatgtgactgg

SEQ ID NO: 237 - DNA, 23 bp, Artificial Sequence
  Description of Artificial Sequence: Synthetic oligonucleotide
gtgtgtayagatgtccagaaggg

SEQ ID NO: 238 - DNA, 23 bp, Artificial Sequence
  Description of Artificial Sequence: Synthetic oligonucleotide
gtcytaggccccaaaaattttgg

SEQ ID NO: 239 - DNA, 23 bp, Artificial Sequence
  Description of Artificial Sequence: Synthetic oligonucleotide
gtcgagaygctggccagctacgg

SEQ ID NO: 240 - DNA, 23 bp, Artificial Sequence
  Description of Artificial Sequence: Synthetic oligonucleotide
tcgagaygctggccagctacggg

SEQ ID NO: 241 - DNA, 23 bp, Artificial Sequence
  Description of Artificial Sequence: Synthetic oligonucleotide
gtcaytgaggttctgcatggtgg

SEQ ID NO: 242 - DNA, 23 bp, Artificial Sequence
  Description of Artificial Sequence: Synthetic oligonucleotide
gcggtcaytgaggttctgcatgg

SEQ ID NO: 243 - DNA, 23 bp, Artificial Sequence
  Description of Artificial Sequence: Synthetic oligonucleotide
gtcaygaaaaagccaagatgcgg

SEQ ID NO: 244 - DNA, 23 bp, Artificial Sequence
  Description of Artificial Sequence: Synthetic oligonucleotide
tcaygaaaaagccaagatgcggg

SEQ ID NO: 245 - DNA, 23 bp, Artificial Sequence
  Description of Artificial Sequence: Synthetic oligonucleotide
gtcayagttctggcacgttttgg

SEQ ID NO: 246 - DNA, 23 bp, Artificial Sequence
  Description of Artificial Sequence: Synthetic oligonucleotide
gtayagaggtattgttcttttgg

SEQ ID NO: 247 - DNA, 23 bp, Artificial Sequence
  Description of Artificial Sequence: Synthetic oligonucleotide
gtagyaggcccaagcccgacagg

SEQ ID NO: 248 - DNA, 23 bp, Artificial Sequence
  Description of Artificial Sequence: Synthetic oligonucleotide
gtaagtgytgaccaaattaccgg

SEQ ID NO: 249 - DNA, 23 bp, Artificial Sequence
  Description of Artificial Sequence: Synthetic oligonucleotide
ggtygggagggaaaagacattgg

SEQ ID NO: 250 - DNA, 23 bp, Artificial Sequence
  Description of Artificial Sequence: Synthetic oligonucleotide
ggttayggtgccgttaagtttgg

SEQ ID NO: 251 - DNA, 23 bp, Artificial Sequence
  Description of Artificial Sequence: Synthetic oligonucleotide
ggtgttgytggaatggagaatgg

SEQ ID NO: 252 - DNA, 23 bp, Artificial Sequence
  Description of Artificial Sequence: Synthetic oligonucleotide
gggattgytgttcatgaattggg

SEQ ID NO: 253 - DNA, 23 bp, Artificial Sequence
  Description of Artificial Sequence: Synthetic oligonucleotide
ggcyatatacaactacgcaaagg

SEQ ID NO: 254 - DNA, 23 bp, Artificial Sequence
  Description of Artificial Sequence: Synthetic oligonucleotide
gggcyagaaatctgttgctatgg

SEQ ID NO: 255 - DNA, 23 bp, Artificial Sequence
  Description of Artificial Sequence: Synthetic oligonucleotide
ggcyagaaatctgttgctatggg

SEQ ID NO: 256 - DNA, 23 bp, Artificial Sequence
  Description of Artificial Sequence: Synthetic oligonucleotide
ggctgytgttggccagcagaagg

SEQ ID NO: 257 - DNA, 23 bp, Artificial Sequence
  Description of Artificial Sequence: Synthetic oligonucleotide
ggctgatyacctcacgctccagg

SEQ ID NO: 258 - DNA, 23 bp, Artificial Sequence
  Description of Artificial Sequence: Synthetic oligonucleotide
gatyacctcacgctccaggttgg

SEQ ID NO: 259 - DNA, 23 bp, Artificial Sequence
  Description of Artificial Sequence: Synthetic oligonucleotide
ggcatagyggaagatctatgagg

SEQ ID NO: 260 - DNA, 23 bp, Artificial Sequence
  Description of Artificial Sequence: Synthetic oligonucleotide
ggcaagygcatcaacacgctggg

SEQ ID NO: 261 - DNA, 23 bp, Artificial Sequence
  Description of Artificial Sequence: Synthetic oligonucleotide
gggcaagygcatcaacacgctgg

SEQ ID NO: 262 - DNA, 23 bp, Artificial Sequence
  Description of Artificial Sequence: Synthetic oligonucleotide
ggataayatcaaacacgtcccgg

SEQ ID NO: 263 - DNA, 23 bp, Artificial Sequence
  Description of Artificial Sequence: Synthetic oligonucleotide
gataayatcaaacacgtcccggg

SEQ ID NO: 264 - DNA, 23 bp, Artificial Sequence
  Description of Artificial Sequence: Synthetic oligonucleotide
ggagyaggggctcagcagggcgg

SEQ ID NO: 265 - DNA, 23 bp, Artificial Sequence
  Description of Artificial Sequence: Synthetic oligonucleotide
ataggagyaggggctcagcaggg

SEQ ID NO: 266 - DNA, 23 bp, Artificial Sequence
  Description of Artificial Sequence: Synthetic oligonucleotide
ggaggyaataactttgtaagtgg

SEQ ID NO: 267 - DNA, 23 bp, Artificial Sequence
  Description of Artificial Sequence: Synthetic oligonucleotide
ggagayggcctccatgaaggagg

SEQ ID NO: 268 - DNA, 23 bp, Artificial Sequence
  Description of Artificial Sequence: Synthetic oligonucleotide
ggaagyggcgtgctgtgctgagg

SEQ ID NO: 269 - DNA, 23 bp, Artificial Sequence
  Description of Artificial Sequence: Synthetic oligonucleotide
ggaagyagtggtggaagtagagg

SEQ ID NO: 270 - DNA, 23 bp, Artificial Sequence
  Description of Artificial Sequence: Synthetic oligonucleotide
gcttttyttcaagctgcccaagg

SEQ ID NO: 271 - DNA, 23 bp, Artificial Sequence
  Description of Artificial Sequence: Synthetic oligonucleotide
gcttgyagatggccatggcgcgg

SEQ ID NO: 272 - DNA, 23 bp, Artificial Sequence
  Description of Artificial Sequence: Synthetic oligonucleotide
gctgtyggccgccggctccgcgg

SEQ ID NO: 273 - DNA, 23 bp, Artificial Sequence
  Description of Artificial Sequence: Synthetic oligonucleotide
cggytggccttgggattgagggg

SEQ ID NO: 274 - DNA, 23 bp, Artificial Sequence
  Description of Artificial Sequence: Synthetic oligonucleotide
gcggytggccttgggattgaggg

SEQ ID NO: 275 - DNA, 23 bp, Artificial Sequence
  Description of Artificial Sequence: Synthetic oligonucleotide
cgcggytggccttgggattgagg

SEQ ID NO: 276 - DNA, 23 bp, Artificial Sequence
  Description of Artificial Sequence: Synthetic oligonucleotide
gccyggggaaaaacagagtcagg

SEQ ID NO: 277 - DNA, 23 bp, Artificial Sequence
  Description of Artificial Sequence: Synthetic oligonucleotide
gccygaaaacacagccacagagg

SEQ ID NO: 278 - DNA, 23 bp, Artificial Sequence
  Description of Artificial Sequence: Synthetic oligonucleotide
gccgggygttggtctgtctctgg

SEQ ID NO: 279 - DNA, 23 bp, Artificial Sequence
  Description of Artificial Sequence: Synthetic oligonucleotide
gccaggyggaagtcatagagcgg

SEQ ID NO: 280 - DNA, 23 bp, Artificial Sequence
  Description of Artificial Sequence: Synthetic oligonucleotide
gccagayactttgtgaagtaagg

SEQ ID NO: 281 - DNA, 23 bp, Artificial Sequence
  Description of Artificial Sequence: Synthetic oligonucleotide
ccagayactttgtgaagtaaggg

SEQ ID NO: 282 - DNA, 23 bp, Artificial Sequence
  Description of Artificial Sequence: Synthetic oligonucleotide
gccagagygagtggctggagtgg

SEQ ID NO: 283 - DNA, 23 bp, Artificial Sequence
  Description of Artificial Sequence: Synthetic oligonucleotide
gccaayggtaacgggcctttggg

SEQ ID NO: 284 - DNA, 23 bp, Artificial Sequence
  Description of Artificial Sequence: Synthetic oligonucleotide
agccaayggtaacgggcctttgg

SEQ ID NO: 285 - DNA, 23 bp, Artificial Sequence
  Description of Artificial Sequence: Synthetic oligonucleotide
gcatgyttgctccaacacagagg

SEQ ID NO: 286 - DNA, 23 bp, Artificial Sequence
  Description of Artificial Sequence: Synthetic oligonucleotide
caagcagygtgagctgctcctgg

SEQ ID NO: 287 - DNA, 23 bp, Artificial Sequence
  Description of Artificial Sequence: Synthetic oligonucleotide
gcagygtgagctgctcctggagg

SEQ ID NO: 288 - DNA, 23 bp, Artificial Sequence
  Description of Artificial Sequence: Synthetic oligonucleotide
gcagtggyaggtgatgttctggg

SEQ ID NO: 289 - DNA, 23 bp, Artificial Sequence
  Description of Artificial Sequence: Synthetic oligonucleotide
gcaggyagagatgaccgctgtgg

SEQ ID NO: 290 - DNA, 23 bp, Artificial Sequence
  Description of Artificial Sequence: Synthetic oligonucleotide
gcaggtyaccatctcctggaggg

SEQ ID NO: 291 - DNA, 23 bp, Artificial Sequence
  Description of Artificial Sequence: Synthetic oligonucleotide
tgcaggtyaccatctcctggagg

SEQ ID NO: 292 - DNA, 23 bp, Artificial Sequence
  Description of Artificial Sequence: Synthetic oligonucleotide
gcaaataygctatctgtagcagg

SEQ ID NO: 293 - DNA, 23 bp, Artificial Sequence
  Description of Artificial Sequence: Synthetic oligonucleotide
gattayatctgtagccttcgggg

SEQ ID NO: 294 - DNA, 23 bp, Artificial Sequence
  Description of Artificial Sequence: Synthetic oligonucleotide
agattayatctgtagccttcggg

SEQ ID NO: 295 - DNA, 23 bp, Artificial Sequence
  Description of Artificial Sequence: Synthetic oligonucleotide
gagattayatctgtagccttcgg

SEQ ID NO: 296 - DNA, 23 bp, Artificial Sequence
  Description of Artificial Sequence: Synthetic oligonucleotide
gatggyagttaatgagctcaggg

SEQ ID NO: 297 - DNA, 23 bp, Artificial Sequence
  Description of Artificial Sequence: Synthetic oligonucleotide
tgatggyagttaatgagctcagg

SEQ ID NO: 298 - DNA, 23 bp, Artificial Sequence
  Description of Artificial Sequence: Synthetic oligonucleotide
gatgaggyagatgcacacaaagg

SEQ ID NO: 299 - DNA, 23 bp, Artificial Sequence
  Description of Artificial Sequence: Synthetic oligonucleotide
gataggyacatatcaaaccaggg

SEQ ID NO: 300 - DNA, 23 bp, Artificial Sequence
  Description of Artificial Sequence: Synthetic oligonucleotide
agataggyacatatcaaaccagg

SEQ ID NO: 301 - DNA, 23 bp, Artificial Sequence
  Description of Artificial Sequence: Synthetic oligonucleotide
gagaytggaaattttggccgtgg

SEQ ID NO: 302 - DNA, 23 bp, Artificial Sequence
  Description of Artificial Sequence: Synthetic oligonucleotide
gataytcacaattacaactgggg

SEQ ID NO: 303 - DNA, 23 bp, Artificial Sequence
  Description of Artificial Sequence: Synthetic oligonucleotide
agataytcacaattacaactggg

SEQ ID NO: 304 - DNA, 23 bp, Artificial Sequence
  Description of Artificial Sequence: Synthetic oligonucleotide
gagataytcacaattacaactgg

SEQ ID NO: 305 - DNA, 23 bp, Artificial Sequence
  Description of Artificial Sequence: Synthetic oligonucleotide
gagaggygagaagagggaagcgg

SEQ ID NO: 306 - DNA, 23 bp, Artificial Sequence
  Description of Artificial Sequence: Synthetic oligonucleotide
gagaagaygacccaggtgagtgg

SEQ ID NO: 307 - DNA, 23 bp, Artificial Sequence
  Description of Artificial Sequence: Synthetic oligonucleotide
gacttygagttcagacatgaggg

SEQ ID NO: 308 - DNA, 23 bp, Artificial Sequence
  Description of Artificial Sequence: Synthetic oligonucleotide
ggacttygagttcagacatgagg

SEQ ID NO: 309 - DNA, 23 bp, Artificial Sequence
  Description of Artificial Sequence: Synthetic oligonucleotide
gacaytgatgaatgtcgctatgg

SEQ ID NO: 310 - DNA, 23 bp, Artificial Sequence
  Description of Artificial Sequence: Synthetic oligonucleotide
gacayggtagatgatcagcgggg

SEQ ID NO: 311 - DNA, 23 bp, Artificial Sequence
  Description of Artificial Sequence: Synthetic oligonucleotide
tgacayggtagatgatcagcggg

SEQ ID NO: 312 - DNA, 23 bp, Artificial Sequence
  Description of Artificial Sequence: Synthetic oligonucleotide
atgacayggtagatgatcagcgg

SEQ ID NO: 313 - DNA, 23 bp, Artificial Sequence
  Description of Artificial Sequence: Synthetic oligonucleotide
gacaygaagggagatgctgaggg

SEQ ID NO: 314 - DNA, 23 bp, Artificial Sequence
  Description of Artificial Sequence: Synthetic oligonucleotide
agacaygaagggagatgctgagg

SEQ ID NO: 315 - DNA, 23 bp, Artificial Sequence
  Description of Artificial Sequence: Synthetic oligonucleotide
gacatytggagggtccccgatgg

SEQ ID NO: 316 - DNA, 23 bp, Artificial Sequence
  Description of Artificial Sequence: Synthetic oligonucleotide
gacagagytcctccacaacatgg

SEQ ID NO: 317 - DNA, 23 bp, Artificial Sequence
  Description of Artificial Sequence: Synthetic oligonucleotide
gaayatataccaaggtatcccgg

SEQ ID NO: 318 - DNA, 23 bp, Artificial Sequence
  Description of Artificial Sequence: Synthetic oligonucleotide
gaatgtaygataatgaacggagg

SEQ ID NO: 319 - DNA, 23 bp, Artificial Sequence
  Description of Artificial Sequence: Synthetic oligonucleotide
gaagtaayaggtgaccccagggg

SEQ ID NO: 320 - DNA, 23 bp, Artificial Sequence
  Description of Artificial Sequence: Synthetic oligonucleotide
gaaggygtggtagggaggcacgg

SEQ ID NO: 321 - DNA, 23 bp, Artificial Sequence
  Description of Artificial Sequence: Synthetic oligonucleotide
aaggygtggtagggaggcacggg

SEQ ID NO: 322 - DNA, 23 bp, Artificial Sequence
  Description of Artificial Sequence: Synthetic oligonucleotide
aggygtggtagggaggcacgggg

SEQ ID NO: 323 - DNA, 23 bp, Artificial Sequence
  Description of Artificial Sequence: Synthetic oligonucleotide
gaaataygatggggcgctcaggg

SEQ ID NO: 324 - DNA, 23 bp, Artificial Sequence
  Description of Artificial Sequence: Synthetic oligonucleotide
agaaataygatggggcgctcagg

SEQ ID NO: 325 - DNA, 23 bp, Artificial Sequence
  Description of Artificial Sequence: Synthetic oligonucleotide
cttgygttatgatggattcatgg

SEQ ID NO: 326 - DNA, 23 bp, Artificial Sequence
  Description of Artificial Sequence: Synthetic oligonucleotide
cttayagatctcatcaatgttgg

SEQ ID NO: 327 - DNA, 23 bp, Artificial Sequence
  Description of Artificial Sequence: Synthetic oligonucleotide
cttaggyaagtaatgcaatatgg

SEQ ID NO: 328 - DNA, 23 bp, Artificial Sequence
  Description of Artificial Sequence: Synthetic oligonucleotide
ctgyggatgcactggggtgcggg

SEQ ID NO: 329 - DNA, 23 bp, Artificial Sequence
  Description of Artificial Sequence: Synthetic oligonucleotide
tctgyggatgcactggggtgcgg

SEQ ID NO: 330 - DNA, 23 bp, Artificial Sequence
  Description of Artificial Sequence: Synthetic oligonucleotide
ctgtgyaagtaatacaactttgg

SEQ ID NO: 331 - DNA, 23 bp, Artificial Sequence
  Description of Artificial Sequence: Synthetic oligonucleotide
ctgtgtgygccagggctgtgggg

SEQ ID NO: 332 - DNA, 23 bp, Artificial Sequence
  Description of Artificial Sequence: Synthetic oligonucleotide
ctgtgagygtgcccaggggcggg

SEQ ID NO: 333 - DNA, 23 bp, Artificial Sequence
  Description of Artificial Sequence: Synthetic oligonucleotide
tgagygtgcccaggggcgggcgg

SEQ ID NO: 334 - DNA, 23 bp, Artificial Sequence
  Description of Artificial Sequence: Synthetic oligonucleotide
ctggyaaaaaacctggtttttgg

SEQ ID NO: 335 - DNA, 23 bp, Artificial Sequence
  Description of Artificial Sequence: Synthetic oligonucleotide
tggyaaaaaacctggtttttggg

SEQ ID NO: 336 - DNA, 23 bp, Artificial Sequence
  Description of Artificial Sequence: Synthetic oligonucleotide
tgatyttcagcctccttttgggg

SEQ ID NO: 337 - DNA, 23 bp, Artificial Sequence
  Description of Artificial Sequence: Synthetic oligonucleotide
ctgatyttcagcctccttttggg

SEQ ID NO: 338 - DNA, 23 bp, Artificial Sequence
  Description of Artificial Sequence: Synthetic oligonucleotide
gctgatyttcagcctccttttgg

SEQ ID NO: 339 - DNA, 23 bp, Artificial Sequence
  Description of Artificial Sequence: Synthetic oligonucleotide
ctgaagytggtctgacctcaggg

SEQ ID NO: 340 - DNA, 23 bp, Artificial Sequence
  Description of Artificial Sequence: Synthetic oligonucleotide
gctgaagytggtctgacctcagg

SEQ ID NO: 341 - DNA, 23 bp, Artificial Sequence
  Description of Artificial Sequence: Synthetic oligonucleotide
ctcytgatgttgttgtgagctgg

SEQ ID NO: 342 - DNA, 23 bp, Artificial Sequence
  Description of Artificial Sequence: Synthetic oligonucleotide
ctcyagggccgcaggttggaggg

SEQ ID NO: 343 - DNA, 23 bp, Artificial Sequence
  Description of Artificial Sequence: Synthetic oligonucleotide
gctcyagggccgcaggttggagg

SEQ ID NO: 344 - DNA, 23 bp, Artificial Sequence
  Description of Artificial Sequence: Synthetic oligonucleotide
ggcgctcyagggccgcaggttgg

SEQ ID NO: 345 - DNA, 23 bp, Artificial Sequence
  Description of Artificial Sequence: Synthetic oligonucleotide
ctcayggttggttggcaagaagg

SEQ ID NO: 346 - DNA, 23 bp, Artificial Sequence
  Description of Artificial Sequence: Synthetic oligonucleotide
ctcaygatctgggatctcagagg

SEQ ID NO: 347 - DNA, 23 bp, Artificial Sequence
  Description of Artificial Sequence: Synthetic oligonucleotide
ctcayaggccattgcgaccacgg

SEQ ID NO: 348 - DNA, 23 bp, Artificial Sequence
  Description of Artificial Sequence: Synthetic oligonucleotide
ctcaayagatgccatctccctgg

SEQ ID NO: 349 - DNA, 23 bp, Artificial Sequence
  Description of Artificial Sequence: Synthetic oligonucleotide
ctataytgttcatcccctctggg

SEQ ID NO: 350 - DNA, 23 bp, Artificial Sequence
  Description of Artificial Sequence: Synthetic oligonucleotide
actataytgttcatcccctctgg

SEQ ID NO: 351 - DNA, 23 bp, Artificial Sequence
  Description of Artificial Sequence: Synthetic oligonucleotide
cgtggytggggaagggcagctgg

SEQ ID NO: 352 - DNA, 23 bp, Artificial Sequence
  Description of Artificial Sequence: Synthetic oligonucleotide
cgtaataygggaaaaaggcgtgg

SEQ ID NO: 353 - DNA, 23 bp, Artificial Sequence
  Description of Artificial Sequence: Synthetic oligonucleotide
aataygggaaaaaggcgtggtgg

SEQ ID NO: 354 - DNA, 23 bp, Artificial Sequence
  Description of Artificial Sequence: Synthetic oligonucleotide
ataygggaaaaaggcgtggtggg

SEQ ID NO: 355 - DNA, 23 bp, Artificial Sequence
  Description of Artificial Sequence: Synthetic oligonucleotide
cggytgaactctcagtcttctgg

SEQ ID NO: 356 - DNA, 23 bp, Artificial Sequence
  Description of Artificial Sequence: Synthetic oligonucleotide
actgcggyatgggcggggccagg

SEQ ID NO: 357 - DNA, 23 bp, Artificial Sequence
  Description of Artificial Sequence: Synthetic oligonucleotide
ctgcggyatgggcggggccaggg

SEQ ID NO: 358 - DNA, 23 bp, Artificial Sequence
  Description of Artificial Sequence: Synthetic oligonucleotide
cggyatgggcggggccagggtgg

SEQ ID NO: 359 - DNA, 23 bp, Artificial Sequence
  Description of Artificial Sequence: Synthetic oligonucleotide
cggtytgaagcgtgcagagatgg

SEQ ID NO: 360 - DNA, 23 bp, Artificial Sequence
  Description of Artificial Sequence: Synthetic oligonucleotide
cgcyttgaaaaaaaaagaaaggg

SEQ ID NO: 361 - DNA, 23 bp, Artificial Sequence
  Description of Artificial Sequence: Synthetic oligonucleotide
tcgcyttgaaaaaaaaagaaagg

SEQ ID NO: 362 - DNA, 23 bp, Artificial Sequence
  Description of Artificial Sequence: Synthetic oligonucleotide
cgcygaagatgaggcagaccagg

SEQ ID NO: 363 - DNA, 23 bp, Artificial Sequence
  Description of Artificial Sequence: Synthetic oligonucleotide
cgcggytgagggtgtagaagtgg

SEQ ID NO: 364 - DNA, 23 bp, Artificial Sequence
  Description of Artificial Sequence: Synthetic oligonucleotide
cgcaygatccacagcaccaatgg

SEQ ID NO: 365 - DNA, 23 bp, Artificial Sequence
  Description of Artificial Sequence: Synthetic oligonucleotide
cgaygttgaagagggcaggcagg

SEQ ID NO: 366 - DNA, 23 bp, Artificial Sequence
  Description of Artificial Sequence: Synthetic oligonucleotide
agcccgaygttgaagagggcagg

SEQ ID NO: 367 - DNA, 23 bp, Artificial Sequence
  Description of Artificial Sequence: Synthetic oligonucleotide
cgaggyggtggtggtccaagtgg

SEQ ID NO: 368 - DNA, 23 bp, Artificial Sequence
  Description of Artificial Sequence: Synthetic oligonucleotide
cgaggyattgccagcagtgcagg

SEQ ID NO: 369 - DNA, 23 bp, Artificial Sequence
  Description of Artificial Sequence: Synthetic oligonucleotide
cgaaaygtgtatctcctcccagg

SEQ ID NO: 370 - DNA, 23 bp, Artificial Sequence
  Description of Artificial Sequence: Synthetic oligonucleotide
cgaaatgyaagtctagttagagg

SEQ ID NO: 371 - DNA, 23 bp, Artificial Sequence
  Description of Artificial Sequence: Synthetic oligonucleotide
gaaatgyaagtctagttagaggg

SEQ ID NO: 372 - DNA, 23 bp, Artificial Sequence
  Description of Artificial Sequence: Synthetic oligonucleotide
cctgtgygtcccccaggggcagg

SEQ ID NO: 373 - DNA, 23 bp, Artificial Sequence
  Description of Artificial Sequence: Synthetic oligonucleotide
ctgtgygtcccccaggggcaggg

SEQ ID NO: 374 - DNA, 23 bp, Artificial Sequence
  Description of Artificial Sequence: Synthetic oligonucleotide
tgtgygtcccccaggggcagggg

SEQ ID NO: 375 - DNA, 23 bp, Artificial Sequence
  Description of Artificial Sequence: Synthetic oligonucleotide
gtgygtcccccaggggcaggggg

SEQ ID NO: 376 - DNA, 23 bp, Artificial Sequence
  Description of Artificial Sequence: Synthetic oligonucleotide
cctaaaaygttggatgctgaagg

SEQ ID NO: 377 - DNA, 23 bp, Artificial Sequence
  Description of Artificial Sequence: Synthetic oligonucleotide
ccggygaggccctggggcggggg

SEQ ID NO: 378 - DNA, 23 bp, Artificial Sequence
  Description of Artificial Sequence: Synthetic oligonucleotide
tccggygaggccctggggcgggg

SEQ ID NO: 379 - DNA, 23 bp, Artificial Sequence
  Description of Artificial Sequence: Synthetic oligonucleotide
atccggygaggccctggggcggg

SEQ ID NO: 380 - DNA, 23 bp, Artificial Sequence
  Description of Artificial Sequence: Synthetic oligonucleotide
gatccggygaggccctggggcgg

SEQ ID NO: 381 - DNA, 23 bp, Artificial Sequence
  Description of Artificial Sequence: Synthetic oligonucleotide
tgayccagggggtctatgggagg

SEQ ID NO: 382 - DNA, 23 bp, Artificial Sequence
  Description of Artificial Sequence: Synthetic oligonucleotide
cggtgayccagggggtctatggg

SEQ ID NO: 383 - DNA, 23 bp, Artificial Sequence
  Description of Artificial Sequence: Synthetic oligonucleotide
ccggtgayccagggggtctatgg

SEQ ID NO: 384 - DNA, 23 bp, Artificial Sequence
  Description of Artificial Sequence: Synthetic oligonucleotide
cccygaaggtggaggatgcaggg

SEQ ID NO: 385 - DNA, 23 bp, Artificial Sequence
  Description of Artificial Sequence: Synthetic oligonucleotide
gcccygaaggtggaggatgcagg

SEQ ID NO: 386 - DNA, 23 bp, Artificial Sequence
  Description of Artificial Sequence: Synthetic oligonucleotide
ccctygggtgcaggtttgtgagg

SEQ ID NO: 387 - DNA, 23 bp, Artificial Sequence
  Description of Artificial Sequence: Synthetic oligonucleotide
cccaygtacctgccgcgccctgg

SEQ ID NO: 388 - DNA, 23 bp, Artificial Sequence
  Description of Artificial Sequence: Synthetic oligonucleotide
ccaytggtcttgagccaagtggg

SEQ ID NO: 389 - DNA, 23 bp, Artificial Sequence
  Description of Artificial Sequence: Synthetic oligonucleotide
tccaytggtcttgagccaagtgg

SEQ ID NO: 390 - DNA, 23 bp, Artificial Sequence
  Description of Artificial Sequence: Synthetic oligonucleotide
ccaygttgtcaatgtccagctgg

SEQ ID NO: 391 - DNA, 23 bp, Artificial Sequence
  Description of Artificial Sequence: Synthetic oligonucleotide
ccaygtggaccctggtgagctgg

SEQ ID NO: 392 - DNA, 23 bp, Artificial Sequence
  Description of Artificial Sequence: Synthetic oligonucleotide
tgtccaygatggcggcgcggcgg

SEQ ID NO: 393 - DNA, 23 bp, Artificial Sequence
  Description of Artificial Sequence: Synthetic oligonucleotide
ccaygatggcggcgcggcggcgg

SEQ ID NO: 394 - DNA, 23 bp, Artificial Sequence
  Description of Artificial Sequence: Synthetic oligonucleotide
ccayagaagcccacgatgtacgg

SEQ ID NO: 395 - DNA, 23 bp, Artificial Sequence
  Description of Artificial Sequence: Synthetic oligonucleotide
ccaggyatcccgggggtaggtgg

SEQ ID NO: 396 - DNA, 23 bp, Artificial Sequence
  Description of Artificial Sequence: Synthetic oligonucleotide
caggyatcccgggggtaggtggg

SEQ ID NO: 397 - DNA, 23 bp, Artificial Sequence
  Description of Artificial Sequence: Synthetic oligonucleotide
ccagaytgtcagcaaacacctgg

SEQ ID NO: 398 - DNA, 23 bp, Artificial Sequence
  Description of Artificial Sequence: Synthetic oligonucleotide
ccaagygagtacagcgcacctgg

SEQ ID NO: 399 - DNA, 23 bp, Artificial Sequence
  Description of Artificial Sequence: Synthetic oligonucleotide
caagygagtacagcgcacctggg

SEQ ID NO: 400 - DNA, 23 bp, Artificial Sequence
  Description of Artificial Sequence: Synthetic oligonucleotide
aagygagtacagcgcacctgggg

SEQ ID NO: 401 - DNA, 23 bp, Artificial Sequence
  Description of Artificial Sequence: Synthetic oligonucleotide
agaytaccaccacctggtggagg

SEQ ID NO: 402 - DNA, 23 bp, Artificial Sequence
  Description of Artificial Sequence: Synthetic oligonucleotide
ccaagaytaccaccacctggtgg

SEQ ID NO: 403 - DNA, 23 bp, Artificial Sequence
  Description of Artificial Sequence: Synthetic oligonucleotide
catgygagtgcaggcggagcagg

SEQ ID NO: 404 - DNA, 23 bp, Artificial Sequence
  Description of Artificial Sequence: Synthetic oligonucleotide
cagytgaatttgtgtgtaaacgg

SEQ ID NO: 405 - DNA, 23 bp, Artificial Sequence
  Description of Artificial Sequence: Synthetic oligonucleotide
cagyggtacagggtgaccacggg

SEQ ID NO: 406 - DNA, 23 bp, Artificial Sequence
  Description of Artificial Sequence: Synthetic oligonucleotide
ccagyggtacagggtgaccacgg

SEQ ID NO: 407 - DNA, 23 bp, Artificial Sequence
  Description of Artificial Sequence: Synthetic oligonucleotide
cagyagagcttgcggcgccgggg

SEQ ID NO: 408 - DNA, 23 bp, Artificial Sequence
  Description of Artificial Sequence: Synthetic oligonucleotide
gcagyagagcttgcggcgccggg

SEQ ID NO: 409 - DNA, 23 bp, Artificial Sequence
  Description of Artificial Sequence: Synthetic oligonucleotide
cgcagyagagcttgcggcgccgg

SEQ ID NO: 410 - DNA, 23 bp, Artificial Sequence
  Description of Artificial Sequence: Synthetic oligonucleotide
cagttagygattggcaactttgg

SEQ ID NO: 411 - DNA, 23 bp, Artificial Sequence
  Description of Artificial Sequence: Synthetic oligonucleotide
cagtggygagactcgcccgcagg

SEQ ID NO: 412 - DNA, 23 bp, Artificial Sequence
  Description of Artificial Sequence: Synthetic oligonucleotide
agtggygagactcgcccgcaggg

SEQ ID NO: 413 - DNA, 23 bp, Artificial Sequence
  Description of Artificial Sequence: Synthetic oligonucleotide
caggtggyacacgaagtcctggg

SEQ ID NO: 414 - DNA, 23 bp, Artificial Sequence
  Description of Artificial Sequence: Synthetic oligonucleotide
cagaggtyctttgacagctttgg

SEQ ID NO: 415 - DNA, 23 bp, Artificial Sequence
  Description of Artificial Sequence: Synthetic oligonucleotide
agcacytgtgaggaagttcctgg

SEQ ID NO: 416 - DNA, 23 bp, Artificial Sequence
  Description of Artificial Sequence: Synthetic oligonucleotide
gcacytgtgaggaagttcctggg

SEQ ID NO: 417 - DNA, 23 bp, Artificial Sequence
  Description of Artificial Sequence: Synthetic oligonucleotide
cacytgtgaggaagttcctgggg

SEQ ID NO: 418 - DNA, 23 bp, Artificial Sequence
  Description of Artificial Sequence: Synthetic oligonucleotide
cacygagggaaagcactgcaggg

SEQ ID NO: 419 - DNA, 23 bp, Artificial Sequence
  Description of Artificial Sequence: Synthetic oligonucleotide
gcacygagggaaagcactgcagg

SEQ ID NO: 420 - DNA, 23 bp, Artificial Sequence
  Description of Artificial Sequence: Synthetic oligonucleotide
cactgytgacgaaggtagcaggg

SEQ ID NO: 421 - DNA, 23 bp, Artificial Sequence
  Description of Artificial Sequence: Synthetic oligonucleotide
gcactgytgacgaaggtagcagg

SEQ ID NO: 422 - DNA, 23 bp, Artificial Sequence
  Description of Artificial Sequence: Synthetic oligonucleotide
cactgygagtaagctggaagtgg

SEQ ID NO: 423 - DNA, 23 bp, Artificial Sequence
  Description of Artificial Sequence: Synthetic oligonucleotide
cactggygtatacacaggtgagg

SEQ ID NO: 424 - DNA, 23 bp, Artificial Sequence
  Description of Artificial Sequence: Synthetic oligonucleotide
cactggayatggaaatagagagg

SEQ ID NO: 425 - DNA, 23 bp, Artificial Sequence
  Description of Artificial Sequence: Synthetic oligonucleotide
cactaytggggtctcggtcaagg

SEQ ID NO: 426 - DNA, 23 bp, Artificial Sequence
  Description of Artificial Sequence: Synthetic oligonucleotide
gcacgygagtggccatcctcagg

SEQ ID NO: 427 - DNA, 23 bp, Artificial Sequence
  Description of Artificial Sequence: Synthetic oligonucleotide
cacgygagtggccatcctcaggg

SEQ ID NO: 428 - DNA, 23 bp, Artificial Sequence
  Description of Artificial Sequence: Synthetic oligonucleotide
cacgagtytcttactgagaatgg

SEQ ID NO: 429 - DNA, 23 bp, Artificial Sequence
  Description of Artificial Sequence: Synthetic oligonucleotide
gagtytcttactgagaatggagg

SEQ ID NO: 430 - DNA, 23 bp, Artificial Sequence
  Description of Artificial Sequence: Synthetic oligonucleotide
cacaytgacacatgtggccaggg

SEQ ID NO: 431 - DNA, 23 bp, Artificial Sequence
  Description of Artificial Sequence: Synthetic oligonucleotide
ccacaytgacacatgtggccagg

SEQ ID NO: 432 - DNA, 23 bp, Artificial Sequence
  Description of Artificial Sequence: Synthetic oligonucleotide
cacataayacgaactggtgctgg

SEQ ID NO: 433 - DNA, 23 bp, Artificial Sequence
  Description of Artificial Sequence: Synthetic oligonucleotide
cacagygggtccctgtctcctgg

SEQ ID NO: 434 - DNA, 23 bp, Artificial Sequence
  Description of Artificial Sequence: Synthetic oligonucleotide
acagygggtccctgtctcctggg

SEQ ID NO: 435 - DNA, 23 bp, Artificial Sequence
  Description of Artificial Sequence: Synthetic oligonucleotide
caaygatgagcttgaagatgagg

SEQ ID NO: 436 - DNA, 23 bp, Artificial Sequence
  Description of Artificial Sequence: Synthetic oligonucleotide
caaygaagaggaattgcccctgg

SEQ ID NO: 437 - DNA, 23 bp, Artificial Sequence
  Description of Artificial Sequence: Synthetic oligonucleotide
caagtygttagctgccaacaagg

SEQ ID NO: 438 - DNA, 23 bp, Artificial Sequence
  Description of Artificial Sequence: Synthetic oligonucleotide
caagaytggggacttcgggctgg

SEQ ID NO: 439 - DNA, 23 bp, Artificial Sequence
  Description of Artificial Sequence: Synthetic oligonucleotide
caagayggcggctcccagggagg

SEQ ID NO: 440 - DNA, 23 bp, Artificial Sequence
  Description of Artificial Sequence: Synthetic oligonucleotide
caagaggytggtgatctgcaagg

SEQ ID NO: 441 - DNA, 23 bp, Artificial Sequence
  Description of Artificial Sequence: Synthetic oligonucleotide
caagaayagtaggtaaggccagg

SEQ ID NO: 442 - DNA, 23 bp, Artificial Sequence
  Description of Artificial Sequence: Synthetic oligonucleotide
caagaaaygtgctgctgatctgg

SEQ ID NO: 443 - DNA, 23 bp, Artificial Sequence
  Description of Artificial Sequence: Synthetic oligonucleotide
aagaaaygtgctgctgatctggg

SEQ ID NO: 444 - DNA, 23 bp, Artificial Sequence
  Description of Artificial Sequence: Synthetic oligonucleotide
caaaatayggaacttgattttgg

SEQ ID NO: 445 - DNA, 23 bp, Artificial Sequence
  Description of Artificial Sequence: Synthetic oligonucleotide
attgaaayagagtaacaagaagg

SEQ ID NO: 446 - DNA, 23 bp, Artificial Sequence
  Description of Artificial Sequence: Synthetic oligonucleotide
atgytggaggcttggaactctgg

SEQ ID NO: 447 - DNA, 23 bp, Artificial Sequence
  Description of Artificial Sequence: Synthetic oligonucleotide
atgtatyaattacagacacttgg

SEQ ID NO: 448 - DNA, 23 bp, Artificial Sequence
  Description of Artificial Sequence: Synthetic oligonucleotide
atggyaaggagcaagggagcagg

SEQ ID NO: 449 - DNA, 23 bp, Artificial Sequence
  Description of Artificial Sequence: Synthetic oligonucleotide
atcytagggtaaggtgacttagg

SEQ ID NO: 450 - DNA, 23 bp, Artificial Sequence
  Description of Artificial Sequence: Synthetic oligonucleotide
atcyaaagcaaaagacaagcagg

SEQ ID NO: 451 - DNA, 23 bp, Artificial Sequence
  Description of Artificial Sequence: Synthetic oligonucleotide
atcaytggggtggatcccgaagg

SEQ ID NO: 452 - DNA, 23 bp, Artificial Sequence
  Description of Artificial Sequence: Synthetic oligonucleotide
tcaytggggtggatcccgaaggg

SEQ ID NO: 453 - DNA, 23 bp, Artificial Sequence
  Description of Artificial Sequence: Synthetic oligonucleotide
atcatytggaacagtctacaagg

SEQ ID NO: 454 - DNA, 23 bp, Artificial Sequence
  Description of Artificial Sequence: Synthetic oligonucleotide
tcatytggaacagtctacaaggg

SEQ ID NO: 455 - DNA, 23 bp, Artificial Sequence
  Description of Artificial Sequence: Synthetic oligonucleotide
atcattgygagtgtattataagg

SEQ ID NO: 456 - DNA, 23 bp, Artificial Sequence
  Description of Artificial Sequence: Synthetic oligonucleotide
tcattgygagtgtattataaggg

SEQ ID NO: 457 - DNA, 23 bp, Artificial Sequence
  Description of Artificial Sequence: Synthetic oligonucleotide
cattgygagtgtattataagggg

SEQ ID NO: 458 - DNA, 23 bp, Artificial Sequence
  Description of Artificial Sequence: Synthetic oligonucleotide
atcatggyaagcaagaaacaagg

SEQ ID NO: 459 - DNA, 23 bp, Artificial Sequence
  Description of Artificial Sequence: Synthetic oligonucleotide
atayagttttcagggcccggagg

SEQ ID NO: 460 - DNA, 23 bp, Artificial Sequence
  Description of Artificial Sequence: Synthetic oligonucleotide
ctgatayagttttcagggcccgg

SEQ ID NO: 461 - DNA, 23 bp, Artificial Sequence
  Description of Artificial Sequence: Synthetic oligonucleotide
atatagaygcctctgctcccagg

SEQ ID NO: 462 - DNA, 23 bp, Artificial Sequence
  Description of Artificial Sequence: Synthetic oligonucleotide
atagtgtycctaaaaggcacggg

SEQ ID NO: 463 - DNA, 23 bp, Artificial Sequence
  Description of Artificial Sequence: Synthetic oligonucleotide
atagatgycagcacgtttgaagg

SEQ ID NO: 464 - DNA, 23 bp, Artificial Sequence
  Description of Artificial Sequence: Synthetic oligonucleotide
agtaygtgaagctccagctgtgg

SEQ ID NO: 465 - DNA, 23 bp, Artificial Sequence
  Description of Artificial Sequence: Synthetic oligonucleotide
cttcaggygagggctggggtggg

SEQ ID NO: 466 - DNA, 23 bp, Artificial Sequence
  Description of Artificial Sequence: Synthetic oligonucleotide
aggygagggctggggtgggcagg

SEQ ID NO: 467 - DNA, 23 bp, Artificial Sequence
  Description of Artificial Sequence: Synthetic oligonucleotide
aggtgagyaatctgtcagcaggg

SEQ ID NO: 468 - DNA, 23 bp, Artificial Sequence
  Description of Artificial Sequence: Synthetic oligonucleotide
agggytggagtaggggccatcgg

SEQ ID NO: 469 - DNA, 23 bp, Artificial Sequence
  Description of Artificial Sequence: Synthetic oligonucleotide
agggaytgcctacaaacaccagg

SEQ ID NO: 470 - DNA, 23 bp, Artificial Sequence
  Description of Artificial Sequence: Synthetic oligonucleotide
agcygtgggacaagagcagccgg

SEQ ID NO: 471 - DNA, 23 bp, Artificial Sequence
  Description of Artificial Sequence: Synthetic oligonucleotide
agcyggtattccctctcgagtgg

SEQ ID NO: 472 - DNA, 23 bp, Artificial Sequence
  Description of Artificial Sequence: Synthetic oligonucleotide
agcygggtgcccagtacccttgg

SEQ ID NO: 473 - DNA, 23 bp, Artificial Sequence
  Description of Artificial Sequence: Synthetic oligonucleotide
gagcyggggactggacaatttgg

SEQ ID NO: 474 - DNA, 23 bp, Artificial Sequence
  Description of Artificial Sequence: Synthetic oligonucleotide
agcyggggactggacaatttggg

SEQ ID NO: 475 - DNA, 23 bp, Artificial Sequence
  Description of Artificial Sequence: Synthetic oligonucleotide
agcyaggtggcgacctgctccgg

SEQ ID NO: 476 - DNA, 23 bp, Artificial Sequence
  Description of Artificial Sequence: Synthetic oligonucleotide
agcttytttgtagacaggcatgg

SEQ ID NO: 477 - DNA, 23 bp, Artificial Sequence
  Description of Artificial Sequence: Synthetic oligonucleotide
agctgtgygatgaagcaggcagg

SEQ ID NO: 478 - DNA, 23 bp, Artificial Sequence
  Description of Artificial Sequence: Synthetic oligonucleotide
gctggaycgaggccttaaaaggg

SEQ ID NO: 479 - DNA, 23 bp, Artificial Sequence
  Description of Artificial Sequence: Synthetic oligonucleotide
agctggaycgaggccttaaaagg

SEQ ID NO: 480 - DNA, 23 bp, Artificial Sequence
  Description of Artificial Sequence: Synthetic oligonucleotide
agctayggccgcagtgattctgg

SEQ ID NO: 481 - DNA, 23 bp, Artificial Sequence
  Description of Artificial Sequence: Synthetic oligonucleotide
attgycttcccattcccaggtgg

SEQ ID NO: 482 - DNA, 23 bp, Artificial Sequence
  Description of Artificial Sequence: Synthetic oligonucleotide
agcattgycttcccattcccagg

SEQ ID NO: 483 - DNA, 23 bp, Artificial Sequence
  Description of Artificial Sequence: Synthetic oligonucleotide
cagcaagbacgtgggcctctggg

SEQ ID NO: 484 - DNA, 23 bp, Artificial Sequence
  Description of Artificial Sequence: Synthetic oligonucleotide
agcaagbacgtgggcctctgggg

SEQ ID NO: 485 - DNA, 23 bp, Artificial Sequence
  Description of Artificial Sequence: Synthetic oligonucleotide
gcaagbacgtgggcctctggggg

SEQ ID NO: 486 - DNA, 23 bp, Artificial Sequence
  Description of Artificial Sequence: Synthetic oligonucleotide
agaytgtggatccgctggcccgg

SEQ ID NO: 487 - DNA, 23 bp, Artificial Sequence
  Description of Artificial Sequence: Synthetic oligonucleotide
agaytggtgtgcgcaacatccgg

SEQ ID NO: 488 - DNA, 23 bp, Artificial Sequence
  Description of Artificial Sequence: Synthetic oligonucleotide
agaygagggtctcagccctgcgg

SEQ ID NO: 489 - DNA, 23 bp, Artificial Sequence
  Description of Artificial Sequence: Synthetic oligonucleotide
agatayggcttctaaaccgaagg

SEQ ID NO: 490 - DNA, 23 bp, Artificial Sequence
  Description of Artificial Sequence: Synthetic oligonucleotide
agaggytgtgtttacggtagcgg

SEQ ID NO: 491 - DNA, 23 bp, Artificial Sequence
  Description of Artificial Sequence: Synthetic oligonucleotide
agaagaygctgtttaatctgagg

SEQ ID NO: 492 - DNA, 23 bp, Artificial Sequence
  Description of Artificial Sequence: Synthetic oligonucleotide
actytttgggatcgacttcctgg

SEQ ID NO: 493 - DNA, 23 bp, Artificial Sequence
  Description of Artificial Sequence: Synthetic oligonucleotide
actytgatagagtaaataatagg

SEQ ID NO: 494 - DNA, 23 bp, Artificial Sequence
  Description of Artificial Sequence: Synthetic oligonucleotide
acttytatagtattgaataaagg

SEQ ID NO: 495 - DNA, 23 bp, Artificial Sequence
  Description of Artificial Sequence: Synthetic oligonucleotide
cttytatagtattgaataaaggg

SEQ ID NO: 496 - DNA, 23 bp, Artificial Sequence
  Description of Artificial Sequence: Synthetic oligonucleotide
acttygatagagtaaataatagg

SEQ ID NO: 497 - DNA, 23 bp, Artificial Sequence
  Description of Artificial Sequence: Synthetic oligonucleotide
acttyatttgactactttaatgg

SEQ ID NO: 498 - DNA, 23 bp, Artificial Sequence
  Description of Artificial Sequence: Synthetic oligonucleotide
cttyattcaaagaccaggaaggg

SEQ ID NO: 499 - DNA, 23 bp, Artificial Sequence
  Description of Artificial Sequence: Synthetic oligonucleotide
acttyattcaaagaccaggaagg

SEQ ID NO: 500 - DNA, 23 bp, Artificial Sequence
  Description of Artificial Sequence: Synthetic oligonucleotide
acttttayagtattgaataaagg

SEQ ID NO: 501 - DNA, 23 bp, Artificial Sequence
  Description of Artificial Sequence: Synthetic oligonucleotide
cttttayagtattgaataaaggg

SEQ ID NO: 502 - DNA, 23 bp, Artificial Sequence
  Description of Artificial Sequence: Synthetic oligonucleotide
acttayagcttcttgtctccagg

SEQ ID NO: 503 - DNA, 23 bp, Artificial Sequence
  Description of Artificial Sequence: Synthetic oligonucleotide
actgataycaggtgagagccagg

SEQ ID NO: 504 - DNA, 23 bp, Artificial Sequence
  Description of Artificial Sequence: Synthetic oligonucleotide
ctgataycaggtgagagccaggg

SEQ ID NO: 505 - DNA, 23 bp, Artificial Sequence
  Description of Artificial Sequence: Synthetic oligonucleotide
acgytgagctggggctgcgcggg

SEQ ID NO: 506 - DNA, 23 bp, Artificial Sequence
  Description of Artificial Sequence: Synthetic oligonucleotide
cacgytgagctggggctgcgcgg

SEQ ID NO: 507 - DNA, 23 bp, Artificial Sequence
  Description of Artificial Sequence: Synthetic oligonucleotide
accytatgatccgcccgccttgg

SEQ ID NO: 508 - DNA, 23 bp, Artificial Sequence
  Description of Artificial Sequence: Synthetic oligonucleotide
accygtgaagggaacagagatgg

SEQ ID NO: 509 - DNA, 23 bp, Artificial Sequence
  Description of Artificial Sequence: Synthetic oligonucleotide
ttcaccygtatctgtatggcagg

SEQ ID NO: 510 - DNA, 23 bp, Artificial Sequence
  Description of Artificial Sequence: Synthetic oligonucleotide
accygtatctgtatggcaggtgg

SEQ ID NO: 511 - DNA, 23 bp, Artificial Sequence
  Description of Artificial Sequence: Synthetic oligonucleotide
accygagatgcaaaatagggagg

SEQ ID NO: 512 - DNA, 23 bp, Artificial Sequence
  Description of Artificial Sequence: Synthetic oligonucleotide
gtgaccygagatgcaaaataggg

SEQ ID NO: 513 - DNA, 23 bp, Artificial Sequence
  Description of Artificial Sequence: Synthetic oligonucleotide
ggtgaccygagatgcaaaatagg

SEQ ID NO: 514 - DNA, 23 bp, Artificial Sequence
  Description of Artificial Sequence: Synthetic oligonucleotide
accygagagggagggcagccagg

SEQ ID NO: 515 - DNA, 23 bp, Artificial Sequence
  Description of Artificial Sequence: Synthetic oligonucleotide
acctgygggtgcgtggctgcagg

SEQ ID NO: 516 - DNA, 23 bp, Artificial Sequence
  Description of Artificial Sequence: Synthetic oligonucleotide
cctgygggtgcgtggctgcaggg

SEQ ID NO: 517 - DNA, 23 bp, Artificial Sequence
  Description of Artificial Sequence: Synthetic oligonucleotide
accgtygtggcccagcaggacgg

SEQ ID NO: 518 - DNA, 23 bp, Artificial Sequence
  Description of Artificial Sequence: Synthetic oligonucleotide
acayatttcttaggtttgagggg

SEQ ID NO: 519 - DNA, 23 bp, Artificial Sequence
  Description of Artificial Sequence: Synthetic oligonucleotide
gacayatttcttaggtttgaggg

SEQ ID NO: 520 - DNA, 23 bp, Artificial Sequence
  Description of Artificial Sequence: Synthetic oligonucleotide
agacayatttcttaggtttgagg

SEQ ID NO: 521 - DNA, 23 bp, Artificial Sequence
  Description of Artificial Sequence: Synthetic oligonucleotide
acayatatccctctggacattgg

SEQ ID NO: 522 - DNA, 23 bp, Artificial Sequence
  Description of Artificial Sequence: Synthetic oligonucleotide
acayagtacaggattcctgcggg

SEQ ID NO: 523 - DNA, 23 bp, Artificial Sequence
  Description of Artificial Sequence: Synthetic oligonucleotide
gacayagtacaggattcctgcgg

SEQ ID NO: 524 - DNA, 23 bp, Artificial Sequence
  Description of Artificial Sequence: Synthetic oligonucleotide
acayaggtgcgacggccccaggg

SEQ ID NO: 525 - DNA, 23 bp, Artificial Sequence
  Description of Artificial Sequence: Synthetic oligonucleotide
gacayaggtgcgacggccccagg

SEQ ID NO: 526 - DNA, 23 bp, Artificial Sequence
  Description of Artificial Sequence: Synthetic oligonucleotide
acattygggcttttggtaagtgg

SEQ ID NO: 527 - DNA, 23 bp, Artificial Sequence
  Description of Artificial Sequence: Synthetic oligonucleotide
acatgyagcaggcgcagtagggg

SEQ ID NO: 528 - DNA, 23 bp, Artificial Sequence
  Description of Artificial Sequence: Synthetic oligonucleotide
gacatgyagcaggcgcagtaggg

SEQ ID NO: 529 - DNA, 23 bp, Artificial Sequence
  Description of Artificial Sequence: Synthetic oligonucleotide
agacatgyagcaggcgcagtagg

SEQ ID NO: 530 - DNA, 23 bp, Artificial Sequence
  Description of Artificial Sequence: Synthetic oligonucleotide
acatayatccctctggacattgg

SEQ ID NO: 531 - DNA, 23 bp, Artificial Sequence
  Description of Artificial Sequence: Synthetic oligonucleotide
acagtyttaggacatcattgtgg

SEQ ID NO: 532 - DNA, 23 bp, Artificial Sequence
  Description of Artificial Sequence: Synthetic oligonucleotide
acagttayaggttctggtcctgg

SEQ ID NO: 533 - DNA, 23 bp, Artificial Sequence
  Description of Artificial Sequence: Synthetic oligonucleotide
gttayaggttctggtcctggagg

SEQ ID NO: 534 - DNA, 23 bp, Artificial Sequence
  Description of Artificial Sequence: Synthetic oligonucleotide
acaaggygagcgtgggctgctgg

SEQ ID NO: 535 - DNA, 23 bp, Artificial Sequence
  Description of Artificial Sequence: Synthetic oligonucleotide
caaggygagcgtgggctgctggg

SEQ ID NO: 536 - DNA, 23 bp, Artificial Sequence
  Description of Artificial Sequence: Synthetic oligonucleotide
acaagatygtctacagaaacagg

SEQ ID NO: 537 - DNA, 23 bp, Artificial Sequence
  Description of Artificial Sequence: Synthetic oligonucleotide
aatyttggaggcagaagctctgg

SEQ ID NO: 538 - DNA, 23 bp, Artificial Sequence
  Description of Artificial Sequence: Synthetic oligonucleotide
aattygttttcttacaaaatcgg

SEQ ID NO: 539 - DNA, 23 bp, Artificial Sequence
  Description of Artificial Sequence: Synthetic oligonucleotide
aatgtyggcaccatcctgggagg

SEQ ID NO: 540 - DNA, 23 bp, Artificial Sequence
  Description of Artificial Sequence: Synthetic oligonucleotide
aatggatyctgaatgtacagagg

SEQ ID NO: 541 - DNA, 23 bp, Artificial Sequence
  Description of Artificial Sequence: Synthetic oligonucleotide
aataaagyagaatatcgtcaagg

SEQ ID NO: 542 - DNA, 23 bp, Artificial Sequence
  Description of Artificial Sequence: Synthetic oligonucleotide
aagygtgtgcctgtgtgccgagg

SEQ ID NO: 543 - DNA, 23 bp, Artificial Sequence
  Description of Artificial Sequence: Synthetic oligonucleotide
aagygattgcagcagtgaaatgg

SEQ ID NO: 544 - DNA, 23 bp, Artificial Sequence
  Description of Artificial Sequence: Synthetic oligonucleotide
aagyagattttctgccaggtggg

SEQ ID NO: 545 - DNA, 23 bp, Artificial Sequence
  Description of Artificial Sequence: Synthetic oligonucleotide
gaagyagattttctgccaggtgg

SEQ ID NO: 546 - DNA, 23 bp, Artificial Sequence
  Description of Artificial Sequence: Synthetic oligonucleotide
gtagaagyagattttctgccagg

SEQ ID NO: 547 - DNA, 23 bp, Artificial Sequence
  Description of Artificial Sequence: Synthetic oligonucleotide
aagtytgatgcagaccagaaagg

SEQ ID NO: 548 - DNA, 23 bp, Artificial Sequence
  Description of Artificial Sequence: Synthetic oligonucleotide
aaggaaygtgttttacccggagg

SEQ ID NO: 549 - DNA, 23 bp, Artificial Sequence
  Description of Artificial Sequence: Synthetic oligonucleotide
aagayggtgacagaaaaggcagg

SEQ ID NO: 550 - DNA, 23 bp, Artificial Sequence
  Description of Artificial Sequence: Synthetic oligonucleotide
aagaayatgcccaaaacatctgg

SEQ ID NO: 551 - DNA, 23 bp, Artificial Sequence
  Description of Artificial Sequence: Synthetic oligonucleotide
aagaaaayctacgccatgggtgg

SEQ ID NO: 552 - DNA, 23 bp, Artificial Sequence
  Description of Artificial Sequence: Synthetic oligonucleotide
aaaayctacgccatgggtggagg

SEQ ID NO: 553 - DNA, 23 bp, Artificial Sequence
  Description of Artificial Sequence: Synthetic oligonucleotide
aacyagagtaatagcgggtcagg

SEQ ID NO: 554 - DNA, 23 bp, Artificial Sequence
  Description of Artificial Sequence: Synthetic oligonucleotide
aactyggtcctgcgggatggggg

SEQ ID NO: 555 - DNA, 23 bp, Artificial Sequence
  Description of Artificial Sequence: Synthetic oligonucleotide
gaactyggtcctgcgggatgggg

SEQ ID NO: 556 - DNA, 23 bp, Artificial Sequence
  Description of Artificial Sequence: Synthetic oligonucleotide
ggaactyggtcctgcgggatggg

SEQ ID NO: 557 - DNA, 23 bp, Artificial Sequence
  Description of Artificial Sequence: Synthetic oligonucleotide
aggaactyggtcctgcgggatgg

SEQ ID NO: 558 - DNA, 23 bp, Artificial Sequence
  Description of Artificial Sequence: Synthetic oligonucleotide
aacagayaatgtcagacaagagg

SEQ ID NO: 559 - DNA, 23 bp, Artificial Sequence
  Description of Artificial Sequence: Synthetic oligonucleotide
aacaayggtggaacctgagaagg

SEQ ID NO: 560 - DNA, 23 bp, Artificial Sequence
  Description of Artificial Sequence: Synthetic oligonucleotide
aaatgyttcctgtacacctgtgg

SEQ ID NO: 561 - DNA, 23 bp, Artificial Sequence
  Description of Artificial Sequence: Synthetic oligonucleotide
aaatatgyggtcacactttgtgg

SEQ ID NO: 562 - DNA, 23 bp, Artificial Sequence
  Description of Artificial Sequence: Synthetic oligonucleotide
aaaggygggcctgggacctgagg

SEQ ID NO: 563 - DNA, 23 bp, Artificial Sequence
  Description of Artificial Sequence: Synthetic oligonucleotide
aaaaygtgttggtgcttgagggg

SEQ ID NO: 564 - DNA, 23 bp, Artificial Sequence
  Description of Artificial Sequence: Synthetic oligonucleotide
gaaaaygtgttggtgcttgaggg

SEQ ID NO: 565 - DNA, 23 bp, Artificial Sequence
  Description of Artificial Sequence: Synthetic oligonucleotide
agaaaaygtgttggtgcttgagg

SEQ ID NO: 566 - DNA, 23 bp, Artificial Sequence
  Description of Artificial Sequence: Synthetic oligonucleotide
aaaattygcaagtatgtcttagg

SEQ ID NO: 567 - DNA, 23 bp, Artificial Sequence
  Description of Artificial Sequence: Synthetic oligonucleotide
aaattygcaagtatgtcttaggg

SEQ ID NO: 568 - DNA, 23 bp, Artificial Sequence
  Description of Artificial Sequence: Synthetic oligonucleotide
tggttcyaatggatgtctgctgg

SEQ ID NO: 569 - DNA, 23 bp, Artificial Sequence
  Description of Artificial Sequence: Synthetic oligonucleotide
ggttcyaatggatgtctgctggg

SEQ ID NO: 570 - DNA, 23 bp, Artificial Sequence
  Description of Artificial Sequence: Synthetic oligonucleotide
tggctgycagggacccagcaagg

SEQ ID NO: 571 - DNA, 23 bp, Artificial Sequence
  Description of Artificial Sequence: Synthetic oligonucleotide
ctgycagggacccagcaaggagg

SEQ ID NO: 572 - DNA, 23 bp, Artificial Sequence
  Description of Artificial Sequence: Synthetic oligonucleotide
agttccygacggctgaggagcgg

SEQ ID NO: 573 - DNA, 23 bp, Artificial Sequence
  Description of Artificial Sequence: Synthetic oligonucleotide
ccagyacggggaggtgtacgagg

SEQ ID NO: 574 - DNA, 23 bp, Artificial Sequence
  Description of Artificial Sequence: Synthetic oligonucleotide
cagyacggggaggtgtacgaggg

SEQ ID NO: 575 - DNA, 23 bp, Artificial Sequence
  Description of Artificial Sequence: Synthetic oligonucleotide
agggcygtcggaccttcgagtgg

SEQ ID NO: 576 - DNA, 23 bp, Artificial Sequence
  Description of Artificial Sequence: Synthetic oligonucleotide
gggcygtcggaccttcgagtggg

SEQ ID NO: 577 - DNA, 23 bp, Artificial Sequence
  Description of Artificial Sequence: Synthetic oligonucleotide
ggcygtcggaccttcgagtgggg

SEQ ID NO: 578 - DNA, 23 bp, Artificial Sequence
  Description of Artificial Sequence: Synthetic oligonucleotide
attcccygatgaggcagatgcgg

SEQ ID NO: 579 - DNA, 23 bp, Artificial Sequence
  Description of Artificial Sequence: Synthetic oligonucleotide
ttcccygatgaggcagatgcggg

SEQ ID NO: 580 - DNA, 23 bp, Artificial Sequence
  Description of Artificial Sequence: Synthetic oligonucleotide
ataccyggcaagcaatagcgcgg

SEQ ID NO: 581 - DNA, 23 bp, Artificial Sequence
  Description of Artificial Sequence: Synthetic oligonucleotide
gtaaytgcaagatctacaaaagg

SEQ ID NO: 582 - DNA, 23 bp, Artificial Sequence
  Description of Artificial Sequence: Synthetic oligonucleotide
acatygacaaccatcggctatgg

SEQ ID NO: 583 - DNA, 23 bp, Artificial Sequence
  Description of Artificial Sequence: Synthetic oligonucleotide
gaccygctgccgtcagcgcctgg

SEQ ID NO: 584 - DNA, 23 bp, Artificial Sequence
  Description of Artificial Sequence: Synthetic oligonucleotide
tcccacyggacaactgcctctgg

SEQ ID NO: 585 - DNA, 23 bp, Artificial Sequence
  Description of Artificial Sequence: Synthetic oligonucleotide
gtagayaccttagagaacaatgg

SEQ ID NO: 586 - DNA, 23 bp, Artificial Sequence
  Description of Artificial Sequence: Synthetic oligonucleotide
tgccaytgctgtggacaacctgg

SEQ ID NO: 587 - DNA, 23 bp, Artificial Sequence
  Description of Artificial Sequence: Synthetic oligonucleotide
gtcgcygcccgtggcccctgcgg

SEQ ID NO: 588 - DNA, 23 bp, Artificial Sequence
  Description of Artificial Sequence: Synthetic oligonucleotide
attggyacgtgatccatcctagg

SEQ ID NO: 589 - DNA, 23 bp, Artificial Sequence
  Description of Artificial Sequence: Synthetic oligonucleotide
gacggcyctgtaggctttggagg

SEQ ID NO: 590 - DNA, 23 bp, Artificial Sequence
  Description of Artificial Sequence: Synthetic oligonucleotide
cggccaygcagtcctgtgccagg

SEQ ID NO: 591 - DNA, 23 bp, Artificial Sequence
  Description of Artificial Sequence: Synthetic oligonucleotide
ggccaygcagtcctgtgccaggg

SEQ ID NO: 592 - DNA, 23 bp, Artificial Sequence
  Description of Artificial Sequence: Synthetic oligonucleotide
ctgcyggtctaccagggcaaagg

SEQ ID NO: 593 - DNA, 23 bp, Artificial Sequence
  Description of Artificial Sequence: Synthetic oligonucleotide
tgatytcttgggagaagaactgg

SEQ ID NO: 594 - DNA, 23 bp, Artificial Sequence
  Description of Artificial Sequence: Synthetic oligonucleotide
gcccygcacgcaaatgtgagtgg

SEQ ID NO: 595 - DNA, 23 bp, Artificial Sequence
  Description of Artificial Sequence: Synthetic oligonucleotide
cccygcacgcaaatgtgagtggg

SEQ ID NO: 596 - DNA, 23 bp, Artificial Sequence
  Description of Artificial Sequence: Synthetic oligonucleotide
ttgtgcyaggaagttatgacagg

SEQ ID NO: 597 - DNA, 23 bp, Artificial Sequence
  Description of Artificial Sequence: Synthetic oligonucleotide
gcgttyacgtgtcccccctttgg

SEQ ID NO: 598 - DNA, 23 bp, Artificial Sequence
  Description of Artificial Sequence: Synthetic oligonucleotide
cgttyacgtgtcccccctttggg

SEQ ID NO: 599 - DNA, 23 bp, Artificial Sequence
  Description of Artificial Sequence: Synthetic oligonucleotide
acgctytcaaggtggctgcccgg

SEQ ID NO: 600 - DNA, 23 bp, Artificial Sequence
  Description of Artificial Sequence: Synthetic oligonucleotide
cgctytcaaggtggctgcccggg

SEQ ID NO: 601 - DNA, 23 bp, Artificial Sequence
  Description of Artificial Sequence: Synthetic oligonucleotide
acttycccttattccatccacgg

SEQ ID NO: 602 - DNA, 23 bp, Artificial Sequence
  Description of Artificial Sequence: Synthetic oligonucleotide
cttycccttattccatccacggg

SEQ ID NO: 603 - DNA, 23 bp, Artificial Sequence
  Description of Artificial Sequence: Synthetic oligonucleotide
catgyttctgctgatcgtgctgg

SEQ ID NO: 604 - DNA, 23 bp, Artificial Sequence
  Description of Artificial Sequence: Synthetic oligonucleotide
atgyttctgctgatcgtgctggg

SEQ ID NO: 605 - DNA, 23 bp, Artificial Sequence
  Description of Artificial Sequence: Synthetic oligonucleotide
aggccyggagccctgtttttagg

SEQ ID NO: 606 - DNA, 23 bp, Artificial Sequence
  Description of Artificial Sequence: Synthetic oligonucleotide
gcagcycttcttagggggtgtgg

SEQ ID NO: 607 - DNA, 23 bp, Artificial Sequence
  Description of Artificial Sequence: Synthetic oligonucleotide
accatccyggagggccgcctggg

SEQ ID NO: 608 - DNA, 23 bp, Artificial Sequence
  Description of Artificial Sequence: Synthetic oligonucleotide
ctacycaactgctggagggaagg

SEQ ID NO: 609 - DNA, 23 bp, Artificial Sequence
  Description of Artificial Sequence: Synthetic oligonucleotide
gcctccyggcgctacggaagtgg

SEQ ID NO: 610 - DNA, 23 bp, Artificial Sequence
  Description of Artificial Sequence: Synthetic oligonucleotide
cctccyggcgctacggaagtggg

SEQ ID NO: 611 - DNA, 23 bp, Artificial Sequence
  Description of Artificial Sequence: Synthetic oligonucleotide
ctccyggcgctacggaagtgggg

SEQ ID NO: 612 - DNA, 23 bp, Artificial Sequence
  Description of Artificial Sequence: Synthetic oligonucleotide
tagagytctgcttgaaacatagg

SEQ ID NO: 613 - DNA, 23 bp, Artificial Sequence
  Description of Artificial Sequence: Synthetic oligonucleotide
catcgcgyccaacaaccgtaagg

SEQ ID NO: 614 - DNA, 23 bp, Artificial Sequence
  Description of Artificial Sequence: Synthetic oligonucleotide
atcgcgyccaacaaccgtaaggg

SEQ ID NO: 615 - DNA, 23 bp, Artificial Sequence
  Description of Artificial Sequence: Synthetic oligonucleotide
agctctycctcatcatggcctgg

SEQ ID NO: 616 - DNA, 23 bp, Artificial Sequence
  Description of Artificial Sequence: Synthetic oligonucleotide
tgtgtgcyggcccatcactttgg

SEQ ID NO: 617 - DNA, 23 bp, Artificial Sequence
  Description of Artificial Sequence: Synthetic oligonucleotide
tccycggtggctcaccacattgg

SEQ ID NO: 618 - DNA, 23 bp, Artificial Sequence
  Description of Artificial Sequence: Synthetic oligonucleotide
ttccyggtcatgcactacagagg

SEQ ID NO: 619 - DNA, 23 bp, Artificial Sequence
  Description of Artificial Sequence: Synthetic oligonucleotide
aatayggcggccgaggcggacgg

SEQ ID NO: 620 - DNA, 23 bp, Artificial Sequence
  Description of Artificial Sequence: Synthetic oligonucleotide
tagcaayggatcgtgggcaatgg

SEQ ID NO: 621 - DNA, 23 bp, Artificial Sequence
  Description of Artificial Sequence: Synthetic oligonucleotide
acctyaactctgggacctgctgg

SEQ ID NO: 622 - DNA, 23 bp, Artificial Sequence
  Description of Artificial Sequence: Synthetic oligonucleotide
gccctgcygtacccgctgcccgg

SEQ ID NO: 623 - DNA, 23 bp, Artificial Sequence
  Description of Artificial Sequence: Synthetic oligonucleotide
tgcygtacccgctgcccggctgg

SEQ ID NO: 624 - DNA, 23 bp, Artificial Sequence
  Description of Artificial Sequence: Synthetic oligonucleotide
atgycatcagcgtggtgttccgg

SEQ ID NO: 625 - DNA, 23 bp, Artificial Sequence
  Description of Artificial Sequence: Synthetic oligonucleotide
cagctacygggatgcccccctgg

SEQ ID NO: 626 - DNA, 23 bp, Artificial Sequence
  Description of Artificial Sequence: Synthetic oligonucleotide
agctacygggatgcccccctggg

SEQ ID NO: 627 - DNA, 23 bp, Artificial Sequence
  Description of Artificial Sequence: Synthetic oligonucleotide
tgagcyggtgggcccaatgcagg

SEQ ID NO: 628 - DNA, 23 bp, Artificial Sequence
  Description of Artificial Sequence: Synthetic oligonucleotide
ttacttcyctttggctatgaagg

SEQ ID NO: 629 - DNA, 23 bp, Artificial Sequence
  Description of Artificial Sequence: Synthetic oligonucleotide
tgcygtaccaagtgccacaaagg

SEQ ID NO: 630 - DNA, 23 bp, Artificial Sequence
  Description of Artificial Sequence: Synthetic oligonucleotide
ctccayactgagctgtgccacgg

SEQ ID NO: 631 - DNA, 23 bp, Artificial Sequence
  Description of Artificial Sequence: Synthetic oligonucleotide
ggggygcttcaaggccattgtgg

SEQ ID NO: 632 - DNA, 23 bp, Artificial Sequence
  Description of Artificial Sequence: Synthetic oligonucleotide
aagctccyggacttttttctggg

SEQ ID NO: 633 - DNA, 23 bp, Artificial Sequence
  Description of Artificial Sequence: Synthetic oligonucleotide
aaayccaccccttacgagtgcgg

SEQ ID NO: 634 - DNA, 23 bp, Artificial Sequence
  Description of Artificial Sequence: Synthetic oligonucleotide
ttccggygagtgggccacactgg

SEQ ID NO: 635 - DNA, 23 bp, Artificial Sequence
  Description of Artificial Sequence: Synthetic oligonucleotide
cacctyctttgcccatcagcagg

SEQ ID NO: 636 - DNA, 23 bp, Artificial Sequence
  Description of Artificial Sequence: Synthetic oligonucleotide
tcaccgcytcaatgacacagagg

SEQ ID NO: 637 - DNA, 23 bp, Artificial Sequence
  Description of Artificial Sequence: Synthetic oligonucleotide
ctayccgccatcccatacattgg

SEQ ID NO: 638 - DNA, 23 bp, Artificial Sequence
  Description of Artificial Sequence: Synthetic oligonucleotide
ttcacccyggtccctgtctgggg

SEQ ID NO: 639 - DNA, 23 bp, Artificial Sequence
  Description of Artificial Sequence: Synthetic oligonucleotide
gaggccayggagctgctgcaggg

SEQ ID NO: 640 - DNA, 23 bp, Artificial Sequence
  Description of Artificial Sequence: Synthetic oligonucleotide
ctcactcyaaaaaactttaccgg

SEQ ID NO: 641 - DNA, 23 bp, Artificial Sequence
  Description of Artificial Sequence: Synthetic oligonucleotide
ggtccyggatgtggtgaggaagg

SEQ ID NO: 642 - DNA, 23 bp, Artificial Sequence
  Description of Artificial Sequence: Synthetic oligonucleotide
cggcytcaaccccacagcaatgg

SEQ ID NO: 643 - DNA, 23 bp, Artificial Sequence
  Description of Artificial Sequence: Synthetic oligonucleotide
ggcytcaaccccacagcaatggg

SEQ ID NO: 644 - DNA, 23 bp, Artificial Sequence
  Description of Artificial Sequence: Synthetic oligonucleotide
gccatccygggtatggggtgggg

SEQ ID NO: 645 - DNA, 23 bp, Artificial Sequence
  Description of Artificial Sequence: Synthetic oligonucleotide
ccatccygggtatggggtggggg

SEQ ID NO: 646 - DNA, 23 bp, Artificial Sequence
  Description of Artificial Sequence: Synthetic oligonucleotide
catccygggtatggggtgggggg

SEQ ID NO: 647 - DNA, 23 bp, Artificial Sequence
  Description of Artificial Sequence: Synthetic oligonucleotide
ggtctytgacgtcttcctggtgg

SEQ ID NO: 648 - DNA, 23 bp, Artificial Sequence
  Description of Artificial Sequence: Synthetic oligonucleotide
cgcyggccaccagcactgccagg

SEQ ID NO: 649 - DNA, 23 bp, Artificial Sequence
  Description of Artificial Sequence: Synthetic oligonucleotide
gagygccgcctggaggtgcgagg

SEQ ID NO: 650 - DNA, 23 bp, Artificial Sequence
  Description of Artificial Sequence: Synthetic oligonucleotide
aatccygtactatgtctacatgg

SEQ ID NO: 651 - DNA, 23 bp, Artificial Sequence
  Description of Artificial Sequence: Synthetic oligonucleotide
atccygtactatgtctacatggg

SEQ ID NO: 652 - DNA, 23 bp, Artificial Sequence
  Description of Artificial Sequence: Synthetic oligonucleotide
tccygtactatgtctacatgggg

SEQ ID NO: 653 - DNA, 23 bp, Artificial Sequence
  Description of Artificial Sequence: Synthetic oligonucleotide
ataytttctggtccattgaaagg

SEQ ID NO: 654 - DNA, 23 bp, Artificial Sequence
  Description of Artificial Sequence: Synthetic oligonucleotide
catctytgactgtgtctacacgg

SEQ ID NO: 655 - DNA, 23 bp, Artificial Sequence
  Description of Artificial Sequence: Synthetic oligonucleotide
aggtgcygttctggggcctacgg

SEQ ID NO: 656 - DNA, 23 bp, Artificial Sequence
  Description of Artificial Sequence: Synthetic oligonucleotide
ggtgcygttctggggcctacggg

SEQ ID NO: 657 - DNA, 23 bp, Artificial Sequence
  Description of Artificial Sequence: Synthetic oligonucleotide
ggacaaygtagaaatactcctgg

SEQ ID NO: 658 - DNA, 23 bp, Artificial Sequence
  Description of Artificial Sequence: Synthetic oligonucleotide
cttaytacagttaccagaacagg

SEQ ID NO: 659 - DNA, 23 bp, Artificial Sequence
  Description of Artificial Sequence: Synthetic oligonucleotide
agcttcayggcgcccgcgccggg

SEQ ID NO: 660 - DNA, 23 bp, Artificial Sequence
  Description of Artificial Sequence: Synthetic oligonucleotide
tcayggcgcccgcgccgggccgg

SEQ ID NO: 661 - DNA, 23 bp, Artificial Sequence
  Description of Artificial Sequence: Synthetic oligonucleotide
atctctcytggggctccctgggg

SEQ ID NO: 662 - DNA, 23 bp, Artificial Sequence
  Description of Artificial Sequence: Synthetic oligonucleotide
tctcytggggctccctggggtgg

SEQ ID NO: 663 - DNA, 23 bp, Artificial Sequence
  Description of Artificial Sequence: Synthetic oligonucleotide
tcggccygtccaggtgagtgtgg

SEQ ID NO: 664 - DNA, 23 bp, Artificial Sequence
  Description of Artificial Sequence: Synthetic oligonucleotide
cttcayctgcaaggaggacctgg

SEQ ID NO: 665 - DNA, 23 bp, Artificial Sequence
  Description of Artificial Sequence: Synthetic oligonucleotide
aagcygctaattggtaggtgagg

SEQ ID NO: 666 - DNA, 23 bp, Artificial Sequence
  Description of Artificial Sequence: Synthetic oligonucleotide
tcgagaycttcgatgtgagttgg

SEQ ID NO: 667 - DNA, 23 bp, Artificial Sequence
  Description of Artificial Sequence: Synthetic oligonucleotide
cgagaycttcgatgtgagttggg

SEQ ID NO: 668 - DNA, 23 bp, Artificial Sequence
  Description of Artificial Sequence: Synthetic oligonucleotide
aagatcaytggtaactcagtagg

SEQ ID NO: 669 - DNA, 23 bp, Artificial Sequence
  Description of Artificial Sequence: Synthetic oligonucleotide
agatcaytggtaactcagtaggg

SEQ ID NO: 670 - DNA, 23 bp, Artificial Sequence
  Description of Artificial Sequence: Synthetic oligonucleotide
gatcaytggtaactcagtagggg

SEQ ID NO: 671 - DNA, 23 bp, Artificial Sequence
  Description of Artificial Sequence: Synthetic oligonucleotide
gggcyggcccccatgtgggaagg

SEQ ID NO: 672 - DNA, 23 bp, Artificial Sequence
  Description of Artificial Sequence: Synthetic oligonucleotide
gcccytcctgctgttcatcatgg

SEQ ID NO: 673 - DNA, 23 bp, Artificial Sequence
  Description of Artificial Sequence: Synthetic oligonucleotide
gatgcyggtgttcgacaacctgg

SEQ ID NO: 674 - DNA, 23 bp, Artificial Sequence
  Description of Artificial Sequence: Synthetic oligonucleotide
aggagygctatttagcatcgagg

SEQ ID NO: 675 - DNA, 23 bp, Artificial Sequence
  Description of Artificial Sequence: Synthetic oligonucleotide
aggycagctaaataagctatcgg

SEQ ID NO: 676 - DNA, 23 bp, Artificial Sequence
  Description of Artificial Sequence: Synthetic oligonucleotide
agaacaygctggggcttttgcgg

SEQ ID NO: 677 - DNA, 23 bp, Artificial Sequence
  Description of Artificial Sequence: Synthetic oligonucleotide
attcytggggagcttagcgatgg

SEQ ID NO: 678 - DNA, 23 bp, Artificial Sequence
  Description of Artificial Sequence: Synthetic oligonucleotide
tctggcycctttctctacacagg

SEQ ID NO: 679 - DNA, 23 bp, Artificial Sequence
  Description of Artificial Sequence: Synthetic oligonucleotide
ggcycctttctctacacaggagg

SEQ ID NO: 680 - DNA, 23 bp, Artificial Sequence
  Description of Artificial Sequence: Synthetic oligonucleotide
tcgcatcytccggatctttgagg

SEQ ID NO: 681 - DNA, 23 bp, Artificial Sequence
  Description of Artificial Sequence: Synthetic oligonucleotide
cgcatcytccggatctttgaggg

SEQ ID NO: 682 - DNA, 23 bp, Artificial Sequence
  Description of Artificial Sequence: Synthetic oligonucleotide
gcatcytccggatctttgagggg

SEQ ID NO: 683 - DNA, 23 bp, Artificial Sequence
  Description of Artificial Sequence: Synthetic oligonucleotide
ctaygggcagagtgggctattgg

SEQ ID NO: 684 - DNA, 23 bp, Artificial Sequence
  Description of Artificial Sequence: Synthetic oligonucleotide
ggacyggctgtcacgggctcagg

SEQ ID NO: 685 - DNA, 23 bp, Artificial Sequence
  Description of Artificial Sequence: Synthetic oligonucleotide
gtgaytgcagagagaggacttgg

SEQ ID NO: 686 - DNA, 23 bp, Artificial Sequence
  Description of Artificial Sequence: Synthetic oligonucleotide
gcttcgcygcatcgctgaaaggg

SEQ ID NO: 687 - DNA, 23 bp, Artificial Sequence
  Description of Artificial Sequence: Synthetic oligonucleotide
aaatctyagagtgtcccatctgg

SEQ ID NO: 688 - DNA, 23 bp, Artificial Sequence
  Description of Artificial Sequence: Synthetic oligonucleotide
ccayctggggaggtaggttcagg

SEQ ID NO: 689 - DNA, 23 bp, Artificial Sequence
  Description of Artificial Sequence: Synthetic oligonucleotide
gaccaytgcgctgcccgcgcagg

SEQ ID NO: 690 - DNA, 23 bp, Artificial Sequence
  Description of Artificial Sequence: Synthetic oligonucleotide
accaytgcgctgcccgcgcaggg

SEQ ID NO: 691 - DNA, 23 bp, Artificial Sequence
  Description of Artificial Sequence: Synthetic oligonucleotide
ccaytgcgctgcccgcgcagggg

SEQ ID NO: 692 - DNA, 23 bp, Artificial Sequence
  Description of Artificial Sequence: Synthetic oligonucleotide
cgcccaygttccccgcaggccgg

SEQ ID NO: 693 - DNA, 23 bp, Artificial Sequence
  Description of Artificial Sequence: Synthetic oligonucleotide
tccygctggccctcgcggcctgg

SEQ ID NO: 694 - DNA, 23 bp, Artificial Sequence
  Description of Artificial Sequence: Synthetic oligonucleotide
cctcatcytcaaggccgccgtgg

SEQ ID NO: 695 - DNA, 23 bp, Artificial Sequence
  Description of Artificial Sequence: Synthetic oligonucleotide
tcggcygcaccccaagttcgtgg

SEQ ID NO: 696 - DNA, 23 bp, Artificial Sequence
  Description of Artificial Sequence: Synthetic oligonucleotide
aggacctygctgggaaacaatgg

SEQ ID NO: 697 - DNA, 23 bp, Artificial Sequence
  Description of Artificial Sequence: Synthetic oligonucleotide
acctygctgggaaacaatggtgg

SEQ ID NO: 698 - DNA, 23 bp, Artificial Sequence
  Description of Artificial Sequence: Synthetic oligonucleotide
cctygctgggaaacaatggtggg

SEQ ID NO: 699 - DNA, 23 bp, Artificial Sequence
  Description of Artificial Sequence: Synthetic oligonucleotide
ggaggctyacgatgagtgcctgg

SEQ ID NO: 700 - DNA, 23 bp, Artificial Sequence
  Description of Artificial Sequence: Synthetic oligonucleotide
ggctyacgatgagtgcctggagg

SEQ ID NO: 701 - DNA, 23 bp, Artificial Sequence
  Description of Artificial Sequence: Synthetic oligonucleotide
ggtgcctytgacgagcacatagg

SEQ ID NO: 702 - DNA, 23 bp, Artificial Sequence
  Description of Artificial Sequence: Synthetic oligonucleotide
ggcgctaygagttctttcgaggg

SEQ ID NO: 703 - DNA, 23 bp, Artificial Sequence
  Description of Artificial Sequence: Synthetic oligonucleotide
gcgctaygagttctttcgagggg

SEQ ID NO: 704 - DNA, 23 bp, Artificial Sequence
  Description of Artificial Sequence: Synthetic oligonucleotide
cccccaygacgtgctggctgcgg

SEQ ID NO: 705 - DNA, 23 bp, Artificial Sequence
  Description of Artificial Sequence: Synthetic oligonucleotide
ccccaygacgtgctggctgcggg

SEQ ID NO: 706 - DNA, 23 bp, Artificial Sequence
  Description of Artificial Sequence: Synthetic oligonucleotide
cccaygacgtgctggctgcgggg

SEQ ID NO: 707 - DNA, 23 bp, Artificial Sequence
  Description of Artificial Sequence: Synthetic oligonucleotide
gcagccyggagcatgggctgtgg

SEQ ID NO: 708 - DNA, 23 bp, Artificial Sequence
  Description of Artificial Sequence: Synthetic oligonucleotide
ctcacctycaacatcactgcggg

SEQ ID NO: 709 - DNA, 23 bp, Artificial Sequence
  Description of Artificial Sequence: Synthetic oligonucleotide
cctgtacycgggctcccagaagg

SEQ ID NO: 710 - DNA, 23 bp, Artificial Sequence
  Description of Artificial Sequence: Synthetic oligonucleotide
cgtgcyggcctcgcgcatggtgg

SEQ ID NO: 711 - DNA, 23 bp, Artificial Sequence
  Description of Artificial Sequence: Synthetic oligonucleotide
tattcagyctaaaagcagcaagg

SEQ ID NO: 712 - DNA, 23 bp, Artificial Sequence
  Description of Artificial Sequence: Synthetic oligonucleotide
cctgcyggccaactccaaagtgg

SEQ ID NO: 713 - DNA, 23 bp, Artificial Sequence
  Description of Artificial Sequence: Synthetic oligonucleotide
tgcytcttcaactaaaatacagg

SEQ ID NO: 714 - DNA, 23 bp, Artificial Sequence
  Description of Artificial Sequence: Synthetic oligonucleotide
aaaatcygtgccaagcaaccagg

SEQ ID NO: 715 - DNA, 23 bp, Artificial Sequence
  Description of Artificial Sequence: Synthetic oligonucleotide
aaatcygtgccaagcaaccaggg

SEQ ID NO: 716 - DNA, 23 bp, Artificial Sequence
  Description of Artificial Sequence: Synthetic oligonucleotide
aatcygtgccaagcaaccagggg

SEQ ID NO: 717 - DNA, 23 bp, Artificial Sequence
  Description of Artificial Sequence: Synthetic oligonucleotide
caagttcyccgaggtgagtccgg

SEQ ID NO: 718 - DNA, 23 bp, Artificial Sequence
  Description of Artificial Sequence: Synthetic oligonucleotide
aagttcyccgaggtgagtccggg

SEQ ID NO: 719 - DNA, 23 bp, Artificial Sequence
  Description of Artificial Sequence: Synthetic oligonucleotide
agttcyccgaggtgagtccgggg

SEQ ID NO: 720 - DNA, 23 bp, Artificial Sequence
  Description of Artificial Sequence: Synthetic oligonucleotide
agcctytggagtgataccacagg

SEQ ID NO: 721 - DNA, 23 bp, Artificial Sequence
  Description of Artificial Sequence: Synthetic oligonucleotide
ctttgtcyatggtgagtctgggg

SEQ ID NO: 722 - DNA, 23 bp, Artificial Sequence
  Description of Artificial Sequence: Synthetic oligonucleotide
ggagcygccctcgccagggaagg

SEQ ID NO: 723 - DNA, 23 bp, Artificial Sequence
  Description of Artificial Sequence: Synthetic oligonucleotide
gcacytgtgatcaacatgcgagg

SEQ ID NO: 724 - DNA, 23 bp, Artificial Sequence
  Description of Artificial Sequence: Synthetic oligonucleotide
cactcycgctcattcactcccgg

SEQ ID NO: 725 - DNA, 23 bp, Artificial Sequence
  Description of Artificial Sequence: Synthetic oligonucleotide
ggacygtggctgccctctcaagg

SEQ ID NO: 726 - DNA, 23 bp, Artificial Sequence
  Description of Artificial Sequence: Synthetic oligonucleotide
agayggcgggatccaggcaaagg

SEQ ID NO: 727 - DNA, 23 bp, Artificial Sequence
  Description of Artificial Sequence: Synthetic oligonucleotide
caaccyggccctcagctactcgg

SEQ ID NO: 728 - DNA, 23 bp, Artificial Sequence
  Description of Artificial Sequence: Synthetic oligonucleotide
ttctycggcttagaggtgactgg

SEQ ID NO: 729 - DNA, 23 bp, Artificial Sequence
  Description of Artificial Sequence: Synthetic oligonucleotide
aaccycatctccctggtgagagg

SEQ ID NO: 730 - DNA, 23 bp, Artificial Sequence
  Description of Artificial Sequence: Synthetic oligonucleotide
cgagcytcgcgtggctcccgagg

SEQ ID NO: 731 - DNA, 23 bp, Artificial Sequence
  Description of Artificial Sequence: Synthetic oligonucleotide
tgggtgyccaataagaccgaagg

SEQ ID NO: 732 - DNA, 23 bp, Artificial Sequence
  Description of Artificial Sequence: Synthetic oligonucleotide
tatgtyctcctacgtcatgctgg

SEQ ID NO: 733 - DNA, 23 bp, Artificial Sequence
  Description of Artificial Sequence: Synthetic oligonucleotide
ctattgcytccaaacatttttgg

SEQ ID NO: 734 - DNA, 23 bp, Artificial Sequence
  Description of Artificial Sequence: Synthetic oligonucleotide
ttcacytctaatggtgattatgg

SEQ ID NO: 735 - DNA, 23 bp, Artificial Sequence
  Description of Artificial Sequence: Synthetic oligonucleotide
tcacytctaatggtgattatggg

SEQ ID NO: 736 - DNA, 23 bp, Artificial Sequence
  Description of Artificial Sequence: Synthetic oligonucleotide
catcaytggccgcacactggtgg

SEQ ID NO: 737 - DNA, 23 bp, Artificial Sequence
  Description of Artificial Sequence: Synthetic oligonucleotide
cgttyggcttgtggtgtaattgg

SEQ ID NO: 738 - DNA, 23 bp, Artificial Sequence
  Description of Artificial Sequence: Synthetic oligonucleotide
gttyggcttgtggtgtaattggg

SEQ ID NO: 739 - DNA, 23 bp, Artificial Sequence
  Description of Artificial Sequence: Synthetic oligonucleotide
ggccagygtgtgtgtgagcctgg

SEQ ID NO: 740 - DNA, 23 bp, Artificial Sequence
  Description of Artificial Sequence: Synthetic oligonucleotide
cctcaacygcgagcagtgtcagg

SEQ ID NO: 741 - DNA, 23 bp, Artificial Sequence
  Description of Artificial Sequence: Synthetic oligonucleotide
ggccaygggctacccggaggtgg

SEQ ID NO: 742 - DNA, 23 bp, Artificial Sequence
  Description of Artificial Sequence: Synthetic oligonucleotide
gttgcyggcgcgcctcgcagtgg

SEQ ID NO: 743 - DNA, 23 bp, Artificial Sequence
  Description of Artificial Sequence: Synthetic oligonucleotide
tggcygtcagttgcaaaaaaagg

SEQ ID NO: 744 - DNA, 23 bp, Artificial Sequence
  Description of Artificial Sequence: Synthetic oligonucleotide
atgcyggagttcagtttgtttgg

SEQ ID NO: 745 - DNA, 23 bp, Artificial Sequence
  Description of Artificial Sequence: Synthetic oligonucleotide
gagtttcycatctacgaaagagg

SEQ ID NO: 746 - DNA, 23 bp, Artificial Sequence
  Description of Artificial Sequence: Synthetic oligonucleotide
ctgccyctgatgagatcaagagg

SEQ ID NO: 747 - DNA, 23 bp, Artificial Sequence
  Description of Artificial Sequence: Synthetic oligonucleotide
catccycaccatcatcacactgg

SEQ ID NO: 748 - DNA, 23 bp, Artificial Sequence
  Description of Artificial Sequence: Synthetic oligonucleotide
aggtcaygtgcttccacccctgg

SEQ ID NO: 749 - DNA, 23 bp, Artificial Sequence
  Description of Artificial Sequence: Synthetic oligonucleotide
caggagcyactcaggaaggtggg

SEQ ID NO: 750 - DNA, 23 bp, Artificial Sequence
  Description of Artificial Sequence: Synthetic oligonucleotide
gcgctyggccgcgcgccttgagg

SEQ ID NO: 751 - DNA, 23 bp, Artificial Sequence
  Description of Artificial Sequence: Synthetic oligonucleotide
aacyggcactgggtcgcttttgg

SEQ ID NO: 752 - DNA, 23 bp, Artificial Sequence
  Description of Artificial Sequence: Synthetic oligonucleotide
acacygttcaggtattgggatgg

SEQ ID NO: 753 - DNA, 23 bp, Artificial Sequence
  Description of Artificial Sequence: Synthetic oligonucleotide
cgccygaccacgccgaccacagg

SEQ ID NO: 754 - DNA, 23 bp, Artificial Sequence
  Description of Artificial Sequence: Synthetic oligonucleotide
gccygaccacgccgaccacaggg

SEQ ID NO: 755 - DNA, 23 bp, Artificial Sequence
  Description of Artificial Sequence: Synthetic oligonucleotide
tccygcgctctgccactgtccgg

SEQ ID NO: 756 - DNA, 23 bp, Artificial Sequence
  Description of Artificial Sequence: Synthetic oligonucleotide
gggaaccygctgctcaccaccgg

SEQ ID NO: 757 - DNA, 23 bp, Artificial Sequence
  Description of Artificial Sequence: Synthetic oligonucleotide
aaccygctgctcaccaccggtgg

SEQ ID NO: 758 - DNA, 23 bp, Artificial Sequence
  Description of Artificial Sequence: Synthetic oligonucleotide
gggycactcaagggacagcccgg

SEQ ID NO: 759 - DNA, 23 bp, Artificial Sequence
  Description of Artificial Sequence: Synthetic oligonucleotide
ggaccygcctgtggatgcagtgg

SEQ ID NO: 760 - DNA, 23 bp, Artificial Sequence
  Description of Artificial Sequence: Synthetic oligonucleotide
ctaccyggacggcaggtgtgtgg

SEQ ID NO: 761 - DNA, 23 bp, Artificial Sequence
  Description of Artificial Sequence: Synthetic oligonucleotide
ggaacacygtccattggcatggg

SEQ ID NO: 762 - DNA, 23 bp, Artificial Sequence
  Description of Artificial Sequence: Synthetic oligonucleotide
gaacacygtccattggcatgggg

SEQ ID NO: 763 - DNA, 23 bp, Artificial Sequence
  Description of Artificial Sequence: Synthetic oligonucleotide
gctccygctgctctccgacacgg

SEQ ID NO: 764 - DNA, 23 bp, Artificial Sequence
  Description of Artificial Sequence: Synthetic oligonucleotide
ttcacaygtctgtgcatgccagg

SEQ ID NO: 765 - DNA, 23 bp, Artificial Sequence
  Description of Artificial Sequence: Synthetic oligonucleotide
atcattcytttgggaagtggagg

SEQ ID NO: 766 - DNA, 23 bp, Artificial Sequence
  Description of Artificial Sequence: Synthetic oligonucleotide
tcattcytttgggaagtggaggg

SEQ ID NO: 767 - DNA, 23 bp, Artificial Sequence
  Description of Artificial Sequence: Synthetic oligonucleotide
aactccaygtataagctgacagg

SEQ ID NO: 768 - DNA, 23 bp, Artificial Sequence
  Description of Artificial Sequence: Synthetic oligonucleotide
catcatgyccatcctggaagagg

SEQ ID NO: 769 - DNA, 23 bp, Artificial Sequence
  Description of Artificial Sequence: Synthetic oligonucleotide
gtagtctytcatgagaggagtgg

SEQ ID NO: 770 - DNA, 23 bp, Artificial Sequence
  Description of Artificial Sequence: Synthetic oligonucleotide
gctcaygagggcacagagcatgg

SEQ ID NO: 771 - DNA, 23 bp, Artificial Sequence
  Description of Artificial Sequence: Synthetic oligonucleotide
atgcaaayatctgtctgaaacgg

SEQ ID NO: 772 - DNA, 23 bp, Artificial Sequence
  Description of Artificial Sequence: Synthetic oligonucleotide
agcaytgcaaccacattgtcagg

SEQ ID NO: 773 - DNA, 23 bp, Artificial Sequence
  Description of Artificial Sequence: Synthetic oligonucleotide
tgcccyccacctggggtcacagg

SEQ ID NO: 774 - DNA, 23 bp, Artificial Sequence
  Description of Artificial Sequence: Synthetic oligonucleotide
ctggggcyggtattcatgaaagg

SEQ ID NO: 775 - DNA, 23 bp, Artificial Sequence
  Description of Artificial Sequence: Synthetic oligonucleotide
gtaatcygcaaaggaggagaagg

SEQ ID NO: 776 - DNA, 23 bp, Artificial Sequence
  Description of Artificial Sequence: Synthetic oligonucleotide
taatcygcaaaggaggagaaggg

SEQ ID NO: 777 - DNA, 23 bp, Artificial Sequence
  Description of Artificial Sequence: Synthetic oligonucleotide
cccyacccaacgctgccgcctgg

SEQ ID NO: 778 - DNA, 23 bp, Artificial Sequence
  Description of Artificial Sequence: Synthetic oligonucleotide
caatcyacttctcccgccgccgg

SEQ ID NO: 779 - DNA, 23 bp, Artificial Sequence
  Description of Artificial Sequence: Synthetic oligonucleotide
aatcyacttctcccgccgccggg

SEQ ID NO: 780 - DNA, 23 bp, Artificial Sequence
  Description of Artificial Sequence: Synthetic oligonucleotide
ctgccagygcctgctgaagaagg

SEQ ID NO: 781 - DNA, 23 bp, Artificial Sequence
  Description of Artificial Sequence: Synthetic oligonucleotide
ccagygcctgctgaagaaggagg

SEQ ID NO: 782 - DNA, 23 bp, Artificial Sequence
  Description of Artificial Sequence: Synthetic oligonucleotide
aaactggyccttatacctgttgg

SEQ ID NO: 783 - DNA, 23 bp, Artificial Sequence
  Description of Artificial Sequence: Synthetic oligonucleotide
aactggyccttatacctgttggg

SEQ ID NO: 784 - DNA, 23 bp, Artificial Sequence
  Description of Artificial Sequence: Synthetic oligonucleotide
cctytaaccgcagcatccatcgg

SEQ ID NO: 785 - DNA, 23 bp, Artificial Sequence
  Description of Artificial Sequence: Synthetic oligonucleotide
ggtctctygcggtgtggaaaggg

SEQ ID NO: 786 - DNA, 23 bp, Artificial Sequence
  Description of Artificial Sequence: Synthetic oligonucleotide
ttaycccatctcagtaaccgtgg

SEQ ID NO: 787 - DNA, 23 bp, Artificial Sequence
  Description of Artificial Sequence: Synthetic oligonucleotide
ttgcygaaggagctgagatgagg

SEQ ID NO: 788 - DNA, 23 bp, Artificial Sequence
  Description of Artificial Sequence: Synthetic oligonucleotide
ggcaytccgagtctttgacaagg

SEQ ID NO: 789 - DNA, 23 bp, Artificial Sequence
  Description of Artificial Sequence: Synthetic oligonucleotide
taatccayaatttgtcatcctgg

SEQ ID NO: 790 - DNA, 23 bp, Artificial Sequence
  Description of Artificial Sequence: Synthetic oligonucleotide
gctytgctttggatggacaatgg

SEQ ID NO: 791 - DNA, 23 bp, Artificial Sequence
  Description of Artificial Sequence: Synthetic oligonucleotide
tcactcaygttcatgcaatgggg

SEQ ID NO: 792 - DNA, 23 bp, Artificial Sequence
  Description of Artificial Sequence: Synthetic oligonucleotide
gcaggacygccccattgcctggg

SEQ ID NO: 793 - DNA, 23 bp, Artificial Sequence
  Description of Artificial Sequence: Synthetic oligonucleotide
tatggyccaagatcgaacgcagg

SEQ ID NO: 794 - DNA, 23 bp, Artificial Sequence
  Description of Artificial Sequence: Synthetic oligonucleotide
gcccgacygcgggatgctggtgg

SEQ ID NO: 795 - DNA, 23 bp, Artificial Sequence
  Description of Artificial Sequence: Synthetic oligonucleotide
aaggcyacatgaactaaccaagg

SEQ ID NO: 796 - DNA, 23 bp, Artificial Sequence
  Description of Artificial Sequence: Synthetic oligonucleotide
caggcgycctcttgctcagccgg

SEQ ID NO: 797 - DNA, 23 bp, Artificial Sequence
  Description of Artificial Sequence: Synthetic oligonucleotide
cggagtcygttctccagggcagg

SEQ ID NO: 798 - DNA, 23 bp, Artificial Sequence
  Description of Artificial Sequence: Synthetic oligonucleotide
ctgcyacctagagttgcgctcgg

SEQ ID NO: 799 - DNA, 23 bp, Artificial Sequence
  Description of Artificial Sequence: Synthetic oligonucleotide
acggctcycatcaactccactgg

SEQ ID NO: 800 - DNA, 23 bp, Artificial Sequence
  Description of Artificial Sequence: Synthetic oligonucleotide
cggctcycatcaactccactggg

SEQ ID NO: 801 - DNA, 23 bp, Artificial Sequence
  Description of Artificial Sequence: Synthetic oligonucleotide
ggctcycatcaactccactgggg

SEQ ID NO: 802 - DNA, 23 bp, Artificial Sequence
  Description of Artificial Sequence: Synthetic oligonucleotide
ggtgcygcggatcggcctgctgg

SEQ ID NO: 803 - DNA, 23 bp, Artificial Sequence
  Description of Artificial Sequence: Synthetic oligonucleotide
gtgcygcggatcggcctgctggg

SEQ ID NO: 804 - DNA, 23 bp, Artificial Sequence
  Description of Artificial Sequence: Synthetic oligonucleotide
gtgcygctgttcttaacccacgg

SEQ ID NO: 805 - DNA, 23 bp, Artificial Sequence
  Description of Artificial Sequence: Synthetic oligonucleotide
tgcygctgttcttaacccacggg

SEQ ID NO: 806 - DNA, 23 bp, Artificial Sequence
  Description of Artificial Sequence: Synthetic oligonucleotide
gctcatcyccttcagtgacaagg

SEQ ID NO: 807 - DNA, 23 bp, Artificial Sequence
  Description of Artificial Sequence: Synthetic oligonucleotide
ggggcygtgacgaccagcccagg

SEQ ID NO: 808 - DNA, 23 bp, Artificial Sequence
  Description of Artificial Sequence: Synthetic oligonucleotide
gtatcygcatgggcgcctgcagg

SEQ ID NO: 809 - DNA, 23 bp, Artificial Sequence
  Description of Artificial Sequence: Synthetic oligonucleotide
gaaatcayaggacaagcctttgg

SEQ ID NO: 810 - DNA, 23 bp, Artificial Sequence
  Description of Artificial Sequence: Synthetic oligonucleotide
gagccyccagagcttgttgaagg

SEQ ID NO: 811 - DNA, 23 bp, Artificial Sequence
  Description of Artificial Sequence: Synthetic oligonucleotide
attgtacycagagcactagaagg

SEQ ID NO: 812 - DNA, 23 bp, Artificial Sequence
  Description of Artificial Sequence: Synthetic oligonucleotide
aggyaacccttaatactacctgg

SEQ ID NO: 813 - DNA, 23 bp, Artificial Sequence
  Description of Artificial Sequence: Synthetic oligonucleotide
gaacggygcgcggacccgggcgg

SEQ ID NO: 814 - DNA, 23 bp, Artificial Sequence
  Description of Artificial Sequence: Synthetic oligonucleotide
aacggygcgcggacccgggcggg

SEQ ID NO: 815 - DNA, 23 bp, Artificial Sequence
  Description of Artificial Sequence: Synthetic oligonucleotide
acttcygtgagaacaagctcagg

SEQ ID NO: 816 - DNA, 23 bp, Artificial Sequence
  Description of Artificial Sequence: Synthetic oligonucleotide
caagctytgataccttcagttgg

SEQ ID NO: 817 - DNA, 23 bp, Artificial Sequence
  Description of Artificial Sequence: Synthetic oligonucleotide
aagctytgataccttcagttggg

SEQ ID NO: 818 - DNA, 23 bp, Artificial Sequence
  Description of Artificial Sequence: Synthetic oligonucleotide
cctccaygactttttcaaaaagg

SEQ ID NO: 819 - DNA, 23 bp, Artificial Sequence
  Description of Artificial Sequence: Synthetic oligonucleotide
cgtcygatcaaaggcgccaaagg

SEQ ID NO: 820 - DNA, 23 bp, Artificial Sequence
  Description of Artificial Sequence: Synthetic oligonucleotide
gtcygatcaaaggcgccaaaggg

SEQ ID NO: 821 - DNA, 23 bp, Artificial Sequence
  Description of Artificial Sequence: Synthetic oligonucleotide
tactaccyggaccaggtgggtgg

SEQ ID NO: 822 - DNA, 23 bp, Artificial Sequence
  Description of Artificial Sequence: Synthetic oligonucleotide
actaccyggaccaggtgggtggg

SEQ ID NO: 823 - DNA, 23 bp, Artificial Sequence
  Description of Artificial Sequence: Synthetic oligonucleotide
ctaccyggaccaggtgggtgggg

SEQ ID NO: 824 - DNA, 23 bp, Artificial Sequence
  Description of Artificial Sequence: Synthetic oligonucleotide
aggcaytggggacgagatcgagg

SEQ ID NO: 825 - DNA, 23 bp, Artificial Sequence
  Description of Artificial Sequence: Synthetic oligonucleotide
gtacgtgyctgtgaacggcaagg

SEQ ID NO: 826 - DNA, 23 bp, Artificial Sequence
  Description of Artificial Sequence: Synthetic oligonucleotide
tacgtgyctgtgaacggcaaggg

SEQ ID NO: 827 - DNA, 23 bp, Artificial Sequence
  Description of Artificial Sequence: Synthetic oligonucleotide
ccgccygcctgtgaagtggatgg

SEQ ID NO: 828 - DNA, 23 bp, Artificial Sequence
  Description of Artificial Sequence: Synthetic oligonucleotide
gaatcccyaccctggcatcctgg

SEQ ID NO: 829 - DNA, 23 bp, Artificial Sequence
  Description of Artificial Sequence: Synthetic oligonucleotide
ggagactyccgctactcagatgg

SEQ ID NO: 830 - DNA, 23 bp, Artificial Sequence
  Description of Artificial Sequence: Synthetic oligonucleotide
gagactyccgctactcagatggg

SEQ ID NO: 831 - DNA, 23 bp, Artificial Sequence
  Description of Artificial Sequence: Synthetic oligonucleotide
agccygtacccatggaggtaagg

SEQ ID NO: 832 - DNA, 23 bp, Artificial Sequence
  Description of Artificial Sequence: Synthetic oligonucleotide
gccygtacccatggaggtaaggg

SEQ ID NO: 833 - DNA, 23 bp, Artificial Sequence
  Description of Artificial Sequence: Synthetic oligonucleotide
gcagayctgctccttccttcagg

SEQ ID NO: 834 - DNA, 23 bp, Artificial Sequence
  Description of Artificial Sequence: Synthetic oligonucleotide
ggccacaygtgtcaatgtggtgg

SEQ ID NO: 835 - DNA, 23 bp, Artificial Sequence
  Description of Artificial Sequence: Synthetic oligonucleotide
gccacaygtgtcaatgtggtggg

SEQ ID NO: 836 - DNA, 23 bp, Artificial Sequence
  Description of Artificial Sequence: Synthetic oligonucleotide
atggcacygccagtgcaaacagg

SEQ ID NO: 837 - DNA, 23 bp, Artificial Sequence
  Description of Artificial Sequence: Synthetic oligonucleotide
tgcyctccaagcagcactaccgg

SEQ ID NO: 838 - DNA, 23 bp, Artificial Sequence
  Description of Artificial Sequence: Synthetic oligonucleotide
ggaccyggcgcgggagccgctgg

SEQ ID NO: 839 - DNA, 23 bp, Artificial Sequence
  Description of Artificial Sequence: Synthetic oligonucleotide
tttcytctggctagaattgctgg

SEQ ID NO: 840 - DNA, 23 bp, Artificial Sequence
  Description of Artificial Sequence: Synthetic oligonucleotide
tggacyatggtgagacctccagg

SEQ ID NO: 841 - DNA, 23 bp, Artificial Sequence
  Description of Artificial Sequence: Synthetic oligonucleotide
caaaggcytcttcttgctggtgg

SEQ ID NO: 842 - DNA, 23 bp, Artificial Sequence
  Description of Artificial Sequence: Synthetic oligonucleotide
ggcytcttcttgctggtggaagg

SEQ ID NO: 843 - DNA, 23 bp, Artificial Sequence
  Description of Artificial Sequence: Synthetic oligonucleotide
ccccyactcctattccaccacgg

SEQ ID NO: 844 - DNA, 23 bp, Artificial Sequence
  Description of Artificial Sequence: Synthetic oligonucleotide
gaagcygccgaagtccctgtcgg

SEQ ID NO: 845 - DNA, 23 bp, Artificial Sequence
  Description of Artificial Sequence: Synthetic oligonucleotide
ccagygccttccaccaagccagg

SEQ ID NO: 846 - DNA, 23 bp, Artificial Sequence
  Description of Artificial Sequence: Synthetic oligonucleotide
ggagtycattttggtggacaagg

SEQ ID NO: 847 - DNA, 23 bp, Artificial Sequence
  Description of Artificial Sequence: Synthetic oligonucleotide
accaagcygctggatcccgaagg

SEQ ID NO: 848 - DNA, 23 bp, Artificial Sequence
  Description of Artificial Sequence: Synthetic oligonucleotide
aagcygctggatcccgaaggtgg

SEQ ID NO: 849 - DNA, 23 bp, Artificial Sequence
  Description of Artificial Sequence: Synthetic oligonucleotide
agcygctggatcccgaaggtggg

SEQ ID NO: 850 - DNA, 23 bp, Artificial Sequence
  Description of Artificial Sequence: Synthetic oligonucleotide
aatgccyccacagtggtcggagg

SEQ ID NO: 851 - DNA, 23 bp, Artificial Sequence
  Description of Artificial Sequence: Synthetic oligonucleotide
gtggagcyggtagctaaagaagg

SEQ ID NO: 852 - DNA, 23 bp, Artificial Sequence
  Description of Artificial Sequence: Synthetic oligonucleotide
tggagcyggtagctaaagaaggg

SEQ ID NO: 853 - DNA, 23 bp, Artificial Sequence
  Description of Artificial Sequence: Synthetic oligonucleotide
ctccagcyggaaggatggcttgg

SEQ ID NO: 854 - DNA, 23 bp, Artificial Sequence
  Description of Artificial Sequence: Synthetic oligonucleotide
atgccyctgtggctgaggcgtgg

SEQ ID NO: 855 - DNA, 23 bp, Artificial Sequence
  Description of Artificial Sequence: Synthetic oligonucleotide
tgaggccygtggcctgctcctgg

SEQ ID NO: 856 - DNA, 23 bp, Artificial Sequence
  Description of Artificial Sequence: Synthetic oligonucleotide
gaggccygtggcctgctcctggg

SEQ ID NO: 857 - DNA, 23 bp, Artificial Sequence
  Description of Artificial Sequence: Synthetic oligonucleotide
cagcyatggccaggccccagtgg

SEQ ID NO: 858 - DNA, 23 bp, Artificial Sequence
  Description of Artificial Sequence: Synthetic oligonucleotide
caggyaacatctgtcccagcagg

SEQ ID NO: 859 - DNA, 23 bp, Artificial Sequence
  Description of Artificial Sequence: Synthetic oligonucleotide
aggyaacatctgtcccagcaggg

SEQ ID NO: 860 - DNA, 23 bp, Artificial Sequence
  Description of Artificial Sequence: Synthetic oligonucleotide
gagacygaagggccaggtggagg

SEQ ID NO: 861 - DNA, 23 bp, Artificial Sequence
  Description of Artificial Sequence: Synthetic oligonucleotide
gatgcyggcagggtcctggctgg

SEQ ID NO: 862 - DNA, 23 bp, Artificial Sequence
  Description of Artificial Sequence: Synthetic oligonucleotide
atgcyggcagggtcctggctggg

SEQ ID NO: 863 - DNA, 23 bp, Artificial Sequence
  Description of Artificial Sequence: Synthetic oligonucleotide
tgcyggcagggtcctggctgggg

SEQ ID NO: 864 - DNA, 23 bp, Artificial Sequence
  Description of Artificial Sequence: Synthetic oligonucleotide
ctacyggaccgactctgtcctgg

SEQ ID NO: 865 - DNA, 23 bp, Artificial Sequence
  Description of Artificial Sequence: Synthetic oligonucleotide
tacyggaccgactctgtcctggg

SEQ ID NO: 866 - DNA, 23 bp, Artificial Sequence
  Description of Artificial Sequence: Synthetic oligonucleotide
ggcgcttycggggggcctcaggg

SEQ ID NO: 867 - DNA, 23 bp, Artificial Sequence
  Description of Artificial Sequence: Synthetic oligonucleotide
aaggyaccgcgggcctcgcgcgg

SEQ ID NO: 868 - DNA, 23 bp, Artificial Sequence
  Description of Artificial Sequence: Synthetic oligonucleotide
aggyaccgcgggcctcgcgcggg

SEQ ID NO: 869 - DNA, 23 bp, Artificial Sequence
  Description of Artificial Sequence: Synthetic oligonucleotide
ttgcaycattggccgcacactgg

SEQ ID NO: 870 - DNA, 23 bp, Artificial Sequence
  Description of Artificial Sequence: Synthetic oligonucleotide
cgcgcytgcgcttcgcttcctgg

SEQ ID NO: 871 - DNA, 23 bp, Artificial Sequence
  Description of Artificial Sequence: Synthetic oligonucleotide
agctcygtttcgtgatgttttgg

SEQ ID NO: 872 - DNA, 23 bp, Artificial Sequence
  Description of Artificial Sequence: Synthetic oligonucleotide
agttacgycaaggtgatgctggg

SEQ ID NO: 873 - DNA, 23 bp, Artificial Sequence
  Description of Artificial Sequence: Synthetic oligonucleotide
ggtgygcgggggcgtgctcgagg

SEQ ID NO: 874 - DNA, 23 bp, Artificial Sequence
  Description of Artificial Sequence: Synthetic oligonucleotide
gtgygcgggggcgtgctcgaggg

SEQ ID NO: 875 - DNA, 23 bp, Artificial Sequence
  Description of Artificial Sequence: Synthetic oligonucleotide
cgccygcgacaagccacagcagg

SEQ ID NO: 876 - DNA, 23 bp, Artificial Sequence
  Description of Artificial Sequence: Synthetic oligonucleotide
ctgcaccyccaccagagccatgg

SEQ ID NO: 877 - DNA, 23 bp, Artificial Sequence
  Description of Artificial Sequence: Synthetic oligonucleotide
agagaycgccaacatgtcactgg

SEQ ID NO: 878 - DNA, 23 bp, Artificial Sequence
  Description of Artificial Sequence: Synthetic oligonucleotide
gctgcyccagatgccctctgtgg

SEQ ID NO: 879 - DNA, 23 bp, Artificial Sequence
  Description of Artificial Sequence: Synthetic oligonucleotide
aactcctyctacagcagcaaagg

SEQ ID NO: 880 - DNA, 23 bp, Artificial Sequence
  Description of Artificial Sequence: Synthetic oligonucleotide
gctgccgygcgtggcccgagggg

SEQ ID NO: 881 - DNA, 23 bp, Artificial Sequence
  Description of Artificial Sequence: Synthetic oligonucleotide
ctgccgygcgtggcccgaggggg

SEQ ID NO: 882 - DNA, 23 bp, Artificial Sequence
  Description of Artificial Sequence: Synthetic oligonucleotide
caagttcytccacaaggtgaggg

SEQ ID NO: 883 - DNA, 23 bp, Artificial Sequence
  Description of Artificial Sequence: Synthetic oligonucleotide
ttcytccacaaggtgagggccgg

SEQ ID NO: 884 - DNA, 23 bp, Artificial Sequence
  Description of Artificial Sequence: Synthetic oligonucleotide
tgggcgcygcatgcgaggagagg

SEQ ID NO: 885 - DNA, 23 bp, Artificial Sequence
  Description of Artificial Sequence: Synthetic oligonucleotide
cgcygcatgcgaggagaggctgg

SEQ ID NO: 886 - DNA, 23 bp, Artificial Sequence
  Description of Artificial Sequence: Synthetic oligonucleotide
tatgacyggcggctggagcccgg

SEQ ID NO: 887 - DNA, 23 bp, Artificial Sequence
  Description of Artificial Sequence: Synthetic oligonucleotide
gaacgagyctgaaatcatcccgg

SEQ ID NO: 888 - DNA, 23 bp, Artificial Sequence
  Description of Artificial Sequence: Synthetic oligonucleotide
aaaaaacyctacactctggatgg

SEQ ID NO: 889 - DNA, 23 bp, Artificial Sequence
  Description of Artificial Sequence: Synthetic oligonucleotide
gatccycgttgtggctgcaaagg

SEQ ID NO: 890 - DNA, 23 bp, Artificial Sequence
  Description of Artificial Sequence: Synthetic oligonucleotide
ccctgcycacctgcctttcctgg

SEQ ID NO: 891 - DNA, 23 bp, Artificial Sequence
  Description of Artificial Sequence: Synthetic oligonucleotide
ggaayctttaaaaaaagtgaagg

SEQ ID NO: 892 - DNA, 23 bp, Artificial Sequence
  Description of Artificial Sequence: Synthetic oligonucleotide
atcacggyaagaatggtacatgg

SEQ ID NO: 893 - DNA, 23 bp, Artificial Sequence
  Description of Artificial Sequence: Synthetic oligonucleotide
tcacggyaagaatggtacatggg

SEQ ID NO: 894 - DNA, 23 bp, Artificial Sequence
  Description of Artificial Sequence: Synthetic oligonucleotide
ctatcyttctcagggagggaagg

SEQ ID NO: 895 - DNA, 23 bp, Artificial Sequence
  Description of Artificial Sequence: Synthetic oligonucleotide
gattgacyggaaggcctacatgg

SEQ ID NO: 896 - DNA, 23 bp, Artificial Sequence
  Description of Artificial Sequence: Synthetic oligonucleotide
ccacyggcattatcgagacctgg

SEQ ID NO: 897 - DNA, 23 bp, Artificial Sequence
  Description of Artificial Sequence: Synthetic oligonucleotide
gtacctgyactgggctgactggg

SEQ ID NO: 898 - DNA, 23 bp, Artificial Sequence
  Description of Artificial Sequence: Synthetic oligonucleotide
ttcctygtatcccaatgctaagg

SEQ ID NO: 899 - DNA, 23 bp, Artificial Sequence
  Description of Artificial Sequence: Synthetic oligonucleotide
acaaaacytcaatgaaacgtggg

SEQ ID NO: 900 - DNA, 23 bp, Artificial Sequence
  Description of Artificial Sequence: Synthetic oligonucleotide
gctccyagtggccatgcacgtgg

SEQ ID NO: 901 - DNA, 23 bp, Artificial Sequence
  Description of Artificial Sequence: Synthetic oligonucleotide
aagatcaytggcaattcagtggg

SEQ ID NO: 902 - DNA, 23 bp, Artificial Sequence
  Description of Artificial Sequence: Synthetic oligonucleotide
agatcaytggcaattcagtgggg

SEQ ID NO: 903 - DNA, 23 bp, Artificial Sequence
  Description of Artificial Sequence: Synthetic oligonucleotide
gatcaytggcaattcagtggggg

SEQ ID NO: 904 - DNA, 23 bp, Artificial Sequence
  Description of Artificial Sequence: Synthetic oligonucleotide
cggyaactaactaactataatgg

SEQ ID NO: 905 - DNA, 23 bp, Artificial Sequence
  Description of Artificial Sequence: Synthetic oligonucleotide
tcccygtgctgctggagttgtgg

SEQ ID NO: 906 - DNA, 23 bp, Artificial Sequence
  Description of Artificial Sequence: Synthetic oligonucleotide
cccygtgctgctggagttgtggg

SEQ ID NO: 907 - DNA, 23 bp, Artificial Sequence
  Description of Artificial Sequence: Synthetic oligonucleotide
ccaacyttttactattcagaagg

SEQ ID NO: 908 - DNA, 23 bp, Artificial Sequence
  Description of Artificial Sequence: Synthetic oligonucleotide
ccgccygcggggataaagccagg

SEQ ID NO: 909 - DNA, 23 bp, Artificial Sequence
  Description of Artificial Sequence: Synthetic oligonucleotide
cgccygcggggataaagccaggg

SEQ ID NO: 910 - DNA, 23 bp, Artificial Sequence
  Description of Artificial Sequence: Synthetic oligonucleotide
gaatctycacagccgctctccgg

SEQ ID NO: 911 - DNA, 23 bp, Artificial Sequence
  Description of Artificial Sequence: Synthetic oligonucleotide
gatgyctgacgggtagcctgtgg

SEQ ID NO: 912 - DNA, 23 bp, Artificial Sequence
  Description of Artificial Sequence: Synthetic oligonucleotide
atgyctgacgggtagcctgtggg

SEQ ID NO: 913 - DNA, 23 bp, Artificial Sequence
  Description of Artificial Sequence: Synthetic oligonucleotide
gctccygggcttcgtggccatgg

SEQ ID NO: 914 - DNA, 23 bp, Artificial Sequence
  Description of Artificial Sequence: Synthetic oligonucleotide
gtcgcyagggctcgtgtcgctgg

SEQ ID NO: 915 - DNA, 23 bp, Artificial Sequence
  Description of Artificial Sequence: Synthetic oligonucleotide
tcgcyagggctcgtgtcgctggg

SEQ ID NO: 916 - DNA, 23 bp, Artificial Sequence
  Description of Artificial Sequence: Synthetic oligonucleotide
ggccgacytctccgtgtcggtgg

SEQ ID NO: 917 - DNA, 23 bp, Artificial Sequence
  Description of Artificial Sequence: Synthetic oligonucleotide
caaccygcagtttggtgagatgg

SEQ ID NO: 918 - DNA, 23 bp, Artificial Sequence
  Description of Artificial Sequence: Synthetic oligonucleotide
cgccaccyaccgccgcctgctgg

SEQ ID NO: 919 - DNA, 23 bp, Artificial Sequence
  Description of Artificial Sequence: Synthetic oligonucleotide
caccyaccgccgcctgctggagg

SEQ ID NO: 920 - DNA, 23 bp, Artificial Sequence
  Description of Artificial Sequence: Synthetic oligonucleotide
accyaccgccgcctgctggaggg

SEQ ID NO: 921 - DNA, 23 bp, Artificial Sequence
  Description of Artificial Sequence: Synthetic oligonucleotide
ttgaagyctcccgcggtgagcgg

SEQ ID NO: 922 - DNA, 23 bp, Artificial Sequence
  Description of Artificial Sequence: Synthetic oligonucleotide
aagyctcccgcggtgagcggcgg

SEQ ID NO: 923 - DNA, 23 bp, Artificial Sequence
  Description of Artificial Sequence: Synthetic oligonucleotide
tggtcygagcttcgacttcgtgg

SEQ ID NO: 924 - DNA, 23 bp, Artificial Sequence
  Description of Artificial Sequence: Synthetic oligonucleotide
ccacttcytgaaaagtactgtgg

SEQ ID NO: 925 - DNA, 23 bp, Artificial Sequence
  Description of Artificial Sequence: Synthetic oligonucleotide
gcaaytgcagaaaatgcaaaagg

SEQ ID NO: 926 - DNA, 23 bp, Artificial Sequence
  Description of Artificial Sequence: Synthetic oligonucleotide
aagatctygaggcatgacattgg

SEQ ID NO: 927 - DNA, 23 bp, Artificial Sequence
  Description of Artificial Sequence: Synthetic oligonucleotide
gacycacagagcccaatttctgg

SEQ ID NO: 928 - DNA, 23 bp, Artificial Sequence
  Description of Artificial Sequence: Synthetic oligonucleotide
tccccatygtcctcagggatggg

SEQ ID NO: 929 - DNA, 23 bp, Artificial Sequence
  Description of Artificial Sequence: Synthetic oligonucleotide
caacytactgagggctttgaagg

SEQ ID NO: 930 - DNA, 23 bp, Artificial Sequence
  Description of Artificial Sequence: Synthetic oligonucleotide
gccttccygcccccccatcaggg

SEQ ID NO: 931 - DNA, 23 bp, Artificial Sequence
  Description of Artificial Sequence: Synthetic oligonucleotide
acactacyacattgccgctgagg

SEQ ID NO: 932 - DNA, 23 bp, Artificial Sequence
  Description of Artificial Sequence: Synthetic oligonucleotide
gtgcagayacttggaggcaatgg

SEQ ID NO: 933 - DNA, 23 bp, Artificial Sequence
  Description of Artificial Sequence: Synthetic oligonucleotide
cagcgaygttcagatactagagg

SEQ ID NO: 934 - DNA, 23 bp, Artificial Sequence
  Description of Artificial Sequence: Synthetic oligonucleotide
atgggcyaagcgaggagcagagg

SEQ ID NO: 935 - DNA, 23 bp, Artificial Sequence
  Description of Artificial Sequence: Synthetic oligonucleotide
attacgyccagtcctacaaatgg

SEQ ID NO: 936 - DNA, 23 bp, Artificial Sequence
  Description of Artificial Sequence: Synthetic oligonucleotide
ttacgyccagtcctacaaatggg

SEQ ID NO: 937 - DNA, 23 bp, Artificial Sequence
  Description of Artificial Sequence: Synthetic oligonucleotide
tacgyccagtcctacaaatgggg

SEQ ID NO: 938 - DNA, 23 bp, Artificial Sequence
  Description of Artificial Sequence: Synthetic oligonucleotide
cgcccggyacggcatcgcgtggg

SEQ ID NO: 939 - DNA, 23 bp, Artificial Sequence
  Description of Artificial Sequence: Synthetic oligonucleotide
gcccggyacggcatcgcgtgggg

SEQ ID NO: 940 - DNA, 23 bp, Artificial Sequence
  Description of Artificial Sequence: Synthetic oligonucleotide
gtttgccyccttcatcgacaagg

SEQ ID NO: 941 - DNA, 23 bp, Artificial Sequence
  Description of Artificial Sequence: Synthetic oligonucleotide
aaggacaytcctgtccccaaggg

SEQ ID NO: 942 - DNA, 23 bp, Artificial Sequence
  Description of Artificial Sequence: Synthetic oligonucleotide
gggccygcggcacctggtggtgg

SEQ ID NO: 943 - DNA, 23 bp, Artificial Sequence
  Description of Artificial Sequence: Synthetic oligonucleotide
gatgaccytgacctcattgctgg

SEQ ID NO: 944 - DNA, 23 bp, Artificial Sequence
  Description of Artificial Sequence: Synthetic oligonucleotide
ctgyttccctttaggaatctcgg

SEQ ID NO: 945 - DNA, 23 bp, Artificial Sequence
  Description of Artificial Sequence: Synthetic oligonucleotide
ctcttctygcacagtggaccggg

SEQ ID NO: 946 - DNA, 23 bp, Artificial Sequence
  Description of Artificial Sequence: Synthetic oligonucleotide
gggacaygttacaacaccgttgg

SEQ ID NO: 947 - DNA, 23 bp, Artificial Sequence
  Description of Artificial Sequence: Synthetic oligonucleotide
cagctgycctgccagggccgcgg

SEQ ID NO: 948 - DNA, 23 bp, Artificial Sequence
  Description of Artificial Sequence: Synthetic oligonucleotide
agctgycctgccagggccgcggg

SEQ ID NO: 949 - DNA, 23 bp, Artificial Sequence
  Description of Artificial Sequence: Synthetic oligonucleotide
gctgycctgccagggccgcgggg

SEQ ID NO: 950 - DNA, 23 bp, Artificial Sequence
  Description of Artificial Sequence: Synthetic oligonucleotide
ctgycctgccagggccgcggggg

SEQ ID NO: 951 - DNA, 23 bp, Artificial Sequence
  Description of Artificial Sequence: Synthetic oligonucleotide
tgcygtccaaaggcacctactgg

SEQ ID NO: 952 - DNA, 23 bp, Artificial Sequence
  Description of Artificial Sequence: Synthetic oligonucleotide
gaaygtccccccaacttcaccgg

SEQ ID NO: 953 - DNA, 23 bp, Artificial Sequence
  Description of Artificial Sequence: Synthetic oligonucleotide
agggyacctggacgaccccacgg

SEQ ID NO: 954 - DNA, 23 bp, Artificial Sequence
  Description of Artificial Sequence: Synthetic oligonucleotide
ggaccycgccttccattcggcgg

SEQ ID NO: 955 - DNA, 23 bp, Artificial Sequence
  Description of Artificial Sequence: Synthetic oligonucleotide
gtccyggaagccattgagccagg

SEQ ID NO: 956 - DNA, 23 bp, Artificial Sequence
  Description of Artificial Sequence: Synthetic oligonucleotide
ccctcytcaatgctgccaactgg

SEQ ID NO: 957 - DNA, 23 bp, Artificial Sequence
  Description of Artificial Sequence: Synthetic oligonucleotide
ttccctgytccgggctggccggg

SEQ ID NO: 958 - DNA, 23 bp, Artificial Sequence
  Description of Artificial Sequence: Synthetic oligonucleotide
agcccaygccaacaatccactgg

SEQ ID NO: 959 - DNA, 23 bp, Artificial Sequence
  Description of Artificial Sequence: Synthetic oligonucleotide
tgtgytccttctggtcatcgtgg

SEQ ID NO: 960 - DNA, 23 bp, Artificial Sequence
  Description of Artificial Sequence: Synthetic oligonucleotide
ggcgacycctttgtctttgaagg

SEQ ID NO: 961 - DNA, 23 bp, Artificial Sequence
  Description of Artificial Sequence: Synthetic oligonucleotide
aatgtacyaccaagaatcaaagg

SEQ ID NO: 962 - DNA, 23 bp, Artificial Sequence
  Description of Artificial Sequence: Synthetic oligonucleotide
ctggtgcytggggctcctggcgg

SEQ ID NO: 963 - DNA, 23 bp, Artificial Sequence
  Description of Artificial Sequence: Synthetic oligonucleotide
gagcccaytgaaatacgctcagg

SEQ ID NO: 964 - DNA, 23 bp, Artificial Sequence
  Description of Artificial Sequence: Synthetic oligonucleotide
attgacycagtcggattcaatgg

SEQ ID NO: 965 - DNA, 23 bp, Artificial Sequence
  Description of Artificial Sequence: Synthetic oligonucleotide
tgcggcygaggtaggtggtctgg

SEQ ID NO: 966 - DNA, 23 bp, Artificial Sequence
  Description of Artificial Sequence: Synthetic oligonucleotide
gcggcygaggtaggtggtctggg

SEQ ID NO: 967 - DNA, 23 bp, Artificial Sequence
  Description of Artificial Sequence: Synthetic oligonucleotide
gacttctyggccctggatcttgg

SEQ ID NO: 968 - DNA, 23 bp, Artificial Sequence
  Description of Artificial Sequence: Synthetic oligonucleotide
ttctyggccctggatcttggagg

SEQ ID NO: 969 - DNA, 23 bp, Artificial Sequence
  Description of Artificial Sequence: Synthetic oligonucleotide
agcyccagaagcctttcttttgg

SEQ ID NO: 970 - DNA, 23 bp, Artificial Sequence
  Description of Artificial Sequence: Synthetic oligonucleotide
tggagygcattgagtagggccgg

SEQ ID NO: 971 - DNA, 23 bp, Artificial Sequence
  Description of Artificial Sequence: Synthetic oligonucleotide
ggaccygctcaatgtcaagctgg

SEQ ID NO: 972 - DNA, 23 bp, Artificial Sequence
  Description of Artificial Sequence: Synthetic oligonucleotide
taccaggygtccctgaattctgg

SEQ ID NO: 973 - DNA, 23 bp, Artificial Sequence
  Description of Artificial Sequence: Synthetic oligonucleotide
aaagaayctgtagatcaaagagg

SEQ ID NO: 974 - DNA, 23 bp, Artificial Sequence
  Description of Artificial Sequence: Synthetic oligonucleotide
acgaacaycttcctcaaatttgg

SEQ ID NO: 975 - DNA, 23 bp, Artificial Sequence
  Description of Artificial Sequence: Synthetic oligonucleotide
gacgtyctctgagaggacgctgg

SEQ ID NO: 976 - DNA, 23 bp, Artificial Sequence
  Description of Artificial Sequence: Synthetic oligonucleotide
gaagcyggaggcgcaggtgcagg

SEQ ID NO: 977 - DNA, 23 bp, Artificial Sequence
  Description of Artificial Sequence: Synthetic oligonucleotide
caaaccyatatccgcagagttgg

SEQ ID NO: 978 - DNA, 23 bp, Artificial Sequence
  Description of Artificial Sequence: Synthetic oligonucleotide
tggccttycctggccccaggtgg

SEQ ID NO: 979 - DNA, 23 bp, Artificial Sequence
  Description of Artificial Sequence: Synthetic oligonucleotide
ggccttycctggccccaggtggg

SEQ ID NO: 980 - DNA, 23 bp, Artificial Sequence
  Description of Artificial Sequence: Synthetic oligonucleotide
gacttcaytgaggaccagggtgg

SEQ ID NO: 981 - DNA, 23 bp, Artificial Sequence
  Description of Artificial Sequence: Synthetic oligonucleotide
acttcaytgaggaccagggtggg

SEQ ID NO: 982 - DNA, 23 bp, Artificial Sequence
  Description of Artificial Sequence: Synthetic oligonucleotide
cttcygggccgggaccgtgatgg

SEQ ID NO: 983 - DNA, 23 bp, Artificial Sequence
  Description of Artificial Sequence: Synthetic oligonucleotide
ttcygggccgggaccgtgatggg

SEQ ID NO: 984 - DNA, 23 bp, Artificial Sequence
  Description of Artificial Sequence: Synthetic oligonucleotide
cagccygatccccatcactgtgg

SEQ ID NO: 985 - DNA, 23 bp, Artificial Sequence
  Description of Artificial Sequence: Synthetic oligonucleotide
gccyctaccctgggctcatctgg

SEQ ID NO: 986 - DNA, 23 bp, Artificial Sequence
  Description of Artificial Sequence: Synthetic oligonucleotide
tctcacygctagaaaagacttgg

SEQ ID NO: 987 - DNA, 23 bp, Artificial Sequence
  Description of Artificial Sequence: Synthetic oligonucleotide
gggcagygtacttgccgcactgg

SEQ ID NO: 988 - DNA, 23 bp, Artificial Sequence
  Description of Artificial Sequence: Synthetic oligonucleotide
gagtyctttgcccttttgagagg

SEQ ID NO: 989 - DNA, 23 bp, Artificial Sequence
  Description of Artificial Sequence: Synthetic oligonucleotide
ccgccgcyattaccccggccagg

SEQ ID NO: 990 - DNA, 23 bp, Artificial Sequence
  Description of Artificial Sequence: Synthetic oligonucleotide
cgccgcyattaccccggccaggg

SEQ ID NO: 991 - DNA, 23 bp, Artificial Sequence
  Description of Artificial Sequence: Synthetic oligonucleotide
ccaaaacycacctttcctggtgg

SEQ ID NO: 992 - DNA, 23 bp, Artificial Sequence
  Description of Artificial Sequence: Synthetic oligonucleotide
ggaccagyacatgaggactgggg

SEQ ID NO: 993 - DNA, 23 bp, Artificial Sequence
  Description of Artificial Sequence: Synthetic oligonucleotide
ccagyacatgaggactggggagg

SEQ ID NO: 994 - DNA, 23 bp, Artificial Sequence
  Description of Artificial Sequence: Synthetic oligonucleotide
cagyacatgaggactggggaggg

SEQ ID NO: 995 - DNA, 23 bp, Artificial Sequence
  Description of Artificial Sequence: Synthetic oligonucleotide
cagcagcygcaggagcacctggg

SEQ ID NO: 996 - DNA, 23 bp, Artificial Sequence
  Description of Artificial Sequence: Synthetic oligonucleotide
tgccatcycactggcgtacgagg

SEQ ID NO: 997 - DNA, 23 bp, Artificial Sequence
  Description of Artificial Sequence: Synthetic oligonucleotide
aggacyctgagccaggggcccgg

SEQ ID NO: 998 - DNA, 23 bp, Artificial Sequence
  Description of Artificial Sequence: Synthetic oligonucleotide
ggccgcygcccaacgccatccgg

SEQ ID NO: 999 - DNA, 23 bp, Artificial Sequence
  Description of Artificial Sequence: Synthetic oligonucleotide
tgcacytgccgtgggtgcagagg

SEQ ID NO: 1000 - DNA, 23 bp, Artificial Sequence
  Description of Artificial Sequence: Synthetic oligonucleotide
agcgcycctcagcatctgccagg

SEQ ID NO: 1001 - DNA, 23 bp, Artificial Sequence
  Description of Artificial Sequence: Synthetic oligonucleotide
accacygggggtaaaaaaagggg

SEQ ID NO: 1002 - DNA, 23 bp, Artificial Sequence
  Description of Artificial Sequence: Synthetic oligonucleotide
taccacygggggtaaaaaaaggg

SEQ ID NO: 1003 - DNA, 23 bp, Artificial Sequence
  Description of Artificial Sequence: Synthetic oligonucleotide
ataccacygggggtaaaaaaagg

SEQ ID NO: 1004 - DNA, 23 bp, Artificial Sequence
  Description of Artificial Sequence: Synthetic oligonucleotide
ccctyctcggagccctgtagagg

SEQ ID NO: 1005 - DNA, 23 bp, Artificial Sequence
  Description of Artificial Sequence: Synthetic oligonucleotide
ttcycctccacgctctcgcctgg

SEQ ID NO: 1006 - DNA, 23 bp, Artificial Sequence
  Description of Artificial Sequence: Synthetic oligonucleotide
gcccctyggagcccacgcagagg

SEQ ID NO: 1007 - DNA, 23 bp, Artificial Sequence
  Description of Artificial Sequence: Synthetic oligonucleotide
ttctcyaaaagcttctgataagg

SEQ ID NO: 1008 - DNA, 23 bp, Artificial Sequence
  Description of Artificial Sequence: Synthetic oligonucleotide
attgycgtcgtcgtcgtcgcagg

SEQ ID NO: 1009 - DNA, 23 bp, Artificial Sequence
  Description of Artificial Sequence: Synthetic oligonucleotide
gtacygtaaggaagattctcggg

SEQ ID NO: 1010 - DNA, 23 bp, Artificial Sequence
  Description of Artificial Sequence: Synthetic oligonucleotide
ggtacygtaaggaagattctcgg

SEQ ID NO: 1011 - DNA, 23 bp, Artificial Sequence
  Description of Artificial Sequence: Synthetic oligonucleotide
tccyggtctgaccattccccagg

SEQ ID NO: 1012 - DNA, 23 bp, Artificial Sequence
  Description of Artificial Sequence: Synthetic oligonucleotide
actcaycaatatctgcaaaatgg

SEQ ID NO: 1013 - DNA, 23 bp, Artificial Sequence
  Description of Artificial Sequence: Synthetic oligonucleotide
gaatagyccatcgcagagcaagg

SEQ ID NO: 1014 - DNA, 23 bp, Artificial Sequence
  Description of Artificial Sequence: Synthetic oligonucleotide
agtccacytggggaggaaggtgg

SEQ ID NO: 1015 - DNA, 23 bp, Artificial Sequence
  Description of Artificial Sequence: Synthetic oligonucleotide
attcacaytcttcaacttaatgg

SEQ ID NO: 1016 - DNA, 23 bp, Artificial Sequence
  Description of Artificial Sequence: Synthetic oligonucleotide
tgttcayactggaagccggcggg

SEQ ID NO: 1017 - DNA, 23 bp, Artificial Sequence
  Description of Artificial Sequence: Synthetic oligonucleotide
ctgttcayactggaagccggcgg

SEQ ID NO: 1018 - DNA, 23 bp, Artificial Sequence
  Description of Artificial Sequence: Synthetic oligonucleotide
gcaytgaccaccacctcaagtgg

SEQ ID NO: 1019 - DNA, 23 bp, Artificial Sequence
  Description of Artificial Sequence: Synthetic oligonucleotide
cggagyccttccacagccgctgg

SEQ ID NO: 1020 - DNA, 23 bp, Artificial Sequence
  Description of Artificial Sequence: Synthetic oligonucleotide
ggatgyacctgaggacaggcagg

SEQ ID NO: 1021 - DNA, 23 bp, Artificial Sequence
  Description of Artificial Sequence: Synthetic oligonucleotide
gacacygaggtgctgagtacggg

SEQ ID NO: 1022 - DNA, 23 bp, Artificial Sequence
  Description of Artificial Sequence: Synthetic oligonucleotide
cgacacygaggtgctgagtacgg

SEQ ID NO: 1023 - DNA, 23 bp, Artificial Sequence
  Description of Artificial Sequence: Synthetic oligonucleotide
tgccgyacccgatcatacctggg

SEQ ID NO: 1024 - DNA, 23 bp, Artificial Sequence
  Description of Artificial Sequence: Synthetic oligonucleotide
atgccgyacccgatcatacctgg

SEQ ID NO: 1025 - DNA, 23 bp, Artificial Sequence
  Description of Artificial Sequence: Synthetic oligonucleotide
gacayacccctgggtggtggagg

SEQ ID NO: 1026 - DNA, 23 bp, Artificial Sequence
  Description of Artificial Sequence: Synthetic oligonucleotide
gcggacayacccctgggtggtgg

SEQ ID NO: 1027 - DNA, 23 bp, Artificial Sequence
  Description of Artificial Sequence: Synthetic oligonucleotide
gtagyagcaggagatcatcgtgg

SEQ ID NO: 1028 - DNA, 23 bp, Artificial Sequence
  Description of Artificial Sequence: Synthetic oligonucleotide
atatytgcatgttttctccaagg

SEQ ID NO: 1029 - DNA, 23 bp, Artificial Sequence
  Description of Artificial Sequence: Synthetic oligonucleotide
ccaygtcagtctctgtcctccgg

SEQ ID NO: 1030 - DNA, 23 bp, Artificial Sequence
  Description of Artificial Sequence: Synthetic oligonucleotide
ctccygagggcttaggattgggg

SEQ ID NO: 1031 - DNA, 23 bp, Artificial Sequence
  Description of Artificial Sequence: Synthetic oligonucleotide
cctccygagggcttaggattggg

SEQ ID NO: 1032 - DNA, 23 bp, Artificial Sequence
  Description of Artificial Sequence: Synthetic oligonucleotide
acctccygagggcttaggattgg

SEQ ID NO: 1033 - DNA, 23 bp, Artificial Sequence
  Description of Artificial Sequence: Synthetic oligonucleotide
tcctacayagtggtactcagagg

SEQ ID NO: 1034 - DNA, 23 bp, Artificial Sequence
  Description of Artificial Sequence: Synthetic oligonucleotide
ctgyactggcagagggattctgg

SEQ ID NO: 1035 - DNA, 23 bp, Artificial Sequence
  Description of Artificial Sequence: Synthetic oligonucleotide
gcgyttccacgatgaagaagggg

SEQ ID NO: 1036 - DNA, 23 bp, Artificial Sequence
  Description of Artificial Sequence: Synthetic oligonucleotide
agcgyttccacgatgaagaaggg

SEQ ID NO: 1037 - DNA, 23 bp, Artificial Sequence
  Description of Artificial Sequence: Synthetic oligonucleotide
cagcgyttccacgatgaagaagg

SEQ ID NO: 1038 - DNA, 23 bp, Artificial Sequence
  Description of Artificial Sequence: Synthetic oligonucleotide
agttgtcycaatacctgctttgg

SEQ ID NO: 1039 - DNA, 23 bp, Artificial Sequence
  Description of Artificial Sequence: Synthetic oligonucleotide
atayctccaacctcaaacttggg

SEQ ID NO: 1040 - DNA, 23 bp, Artificial Sequence
  Description of Artificial Sequence: Synthetic oligonucleotide
gatayctccaacctcaaacttgg

SEQ ID NO: 1041 - DNA, 23 bp, Artificial Sequence
  Description of Artificial Sequence: Synthetic oligonucleotide
ggcactycttggcatagcgacgg

SEQ ID NO: 1042 - DNA, 23 bp, Artificial Sequence
  Description of Artificial Sequence: Synthetic oligonucleotide
gcggtcaytgaggttctgcatgg

SEQ ID NO: 1043 - DNA, 23 bp, Artificial Sequence
  Description of Artificial Sequence: Synthetic oligonucleotide
ctgctgcygtcgtcgtcgcttgg

SEQ ID NO: 1044 - DNA, 23 bp, Artificial Sequence
  Description of Artificial Sequence: Synthetic oligonucleotide
cctycttcacctgcttgaggtgg

SEQ ID NO: 1045 - DNA, 23 bp, Artificial Sequence
  Description of Artificial Sequence: Synthetic oligonucleotide
cctcctycttcacctgcttgagg

SEQ ID NO: 1046 - DNA, 23 bp, Artificial Sequence
  Description of Artificial Sequence: Synthetic oligonucleotide
gtcctgyccctccgccacagtgg

SEQ ID NO: 1047 - DNA, 23 bp, Artificial Sequence
  Description of Artificial Sequence: Synthetic oligonucleotide
gtgccayacctggtgtggggagg

SEQ ID NO: 1048 - DNA, 23 bp, Artificial Sequence
  Description of Artificial Sequence: Synthetic oligonucleotide
aaagactyttcccaccgacatgg

SEQ ID NO: 1049 - DNA, 23 bp, Artificial Sequence
  Description of Artificial Sequence: Synthetic oligonucleotide
tggygcctcatgcagcgtcgagg

SEQ ID NO: 1050 - DNA, 23 bp, Artificial Sequence
  Description of Artificial Sequence: Synthetic oligonucleotide
aagcycttaatatctgtgcatgg

SEQ ID NO: 1051 - DNA, 23 bp, Artificial Sequence
  Description of Artificial Sequence: Synthetic oligonucleotide
taaacygcagagagaaccaaggg

SEQ ID NO: 1052 - DNA, 23 bp, Artificial Sequence
  Description of Artificial Sequence: Synthetic oligonucleotide
gtaaacygcagagagaaccaagg

SEQ ID NO: 1053 - DNA, 23 bp, Artificial Sequence
  Description of Artificial Sequence: Synthetic oligonucleotide
cccacayatccatctgcctgcgg

SEQ ID NO: 1054 - DNA, 23 bp, Artificial Sequence
  Description of Artificial Sequence: Synthetic oligonucleotide
cacccaycttcttcacccctcgg

SEQ ID NO: 1055 - DNA, 23 bp, Artificial Sequence
  Description of Artificial Sequence: Synthetic oligonucleotide
atccattycaaagtaagcaatgg

SEQ ID NO: 1056 - DNA, 23 bp, Artificial Sequence
  Description of Artificial Sequence: Synthetic oligonucleotide
gggccyggcccgcacgtcacagg

SEQ ID NO: 1057 - DNA, 23 bp, Artificial Sequence
  Description of Artificial Sequence: Synthetic oligonucleotide
cgtcygtacgtgggcggcctggg

SEQ ID NO: 1058 - DNA, 23 bp, Artificial Sequence
  Description of Artificial Sequence: Synthetic oligonucleotide
gcgtcygtacgtgggcggcctgg

SEQ ID NO: 1059 - DNA, 23 bp, Artificial Sequence
  Description of Artificial Sequence: Synthetic oligonucleotide
cgcccygcggccgagagggcggg

SEQ ID NO: 1060 - DNA, 23 bp, Artificial Sequence
  Description of Artificial Sequence: Synthetic oligonucleotide
gcgcccygcggccgagagggcgg

SEQ ID NO: 1061 - DNA, 23 bp, Artificial Sequence
  Description of Artificial Sequence: Synthetic oligonucleotide
gttcayagatgtcaaggttctgg

SEQ ID NO: 1062 - DNA, 23 bp, Artificial Sequence
  Description of Artificial Sequence: Synthetic oligonucleotide
ggcayacagctctttggataagg

SEQ ID NO: 1063 - DNA, 23 bp, Artificial Sequence
  Description of Artificial Sequence: Synthetic oligonucleotide
gagcatyctctgtttcaaagagg

SEQ ID NO: 1064 - DNA, 23 bp, Artificial Sequence
  Description of Artificial Sequence: Synthetic oligonucleotide
ggcagcaytgcactgacaggcgg

SEQ ID NO: 1065 - DNA, 23 bp, Artificial Sequence
  Description of Artificial Sequence: Synthetic oligonucleotide
aaggactycccttgcaataaagg

SEQ ID NO: 1066 - DNA, 23 bp, Artificial Sequence
  Description of Artificial Sequence: Synthetic oligonucleotide
gactycagatgtaactcttatgg

SEQ ID NO: 1067 - DNA, 23 bp, Artificial Sequence
  Description of Artificial Sequence: Synthetic oligonucleotide
gactcyagctatatcttcacagg

SEQ ID NO: 1068 - DNA, 23 bp, Artificial Sequence
  Description of Artificial Sequence: Synthetic oligonucleotide
ttccacayccacatcaccattgg

SEQ ID NO: 1069 - DNA, 23 bp, Artificial Sequence
  Description of Artificial Sequence: Synthetic oligonucleotide
atcytctctgagttggtgttggg

SEQ ID NO: 1070 - DNA, 23 bp, Artificial Sequence
  Description of Artificial Sequence: Synthetic oligonucleotide
gatcytctctgagttggtgttgg

SEQ ID NO: 1071 - DNA, 23 bp, Artificial Sequence
  Description of Artificial Sequence: Synthetic oligonucleotide
aacctcgycttccaagtggctgg

SEQ ID NO: 1072 - DNA, 23 bp, Artificial Sequence
  Description of Artificial Sequence: Synthetic oligonucleotide
ccccctycttttgggctcgctgg

SEQ ID NO: 1073 - DNA, 23 bp, Artificial Sequence
  Description of Artificial Sequence: Synthetic oligonucleotide
gccgccgytttggctggcacggg

SEQ ID NO: 1074 - DNA, 23 bp, Artificial Sequence
  Description of Artificial Sequence: Synthetic oligonucleotide
tgggcygttccaagacaccaggg

SEQ ID NO: 1075 - DNA, 23 bp, Artificial Sequence
  Description of Artificial Sequence: Synthetic oligonucleotide
gtgggcygttccaagacaccagg

SEQ ID NO: 1076 - DNA, 23 bp, Artificial Sequence
  Description of Artificial Sequence: Synthetic oligonucleotide
cactgcgyaggtggtgaccccgg

SEQ ID NO: 1077 - DNA, 23 bp, Artificial Sequence
  Description of Artificial Sequence: Synthetic oligonucleotide
gtctyctactcggttcaggcggg

SEQ ID NO: 1078 - DNA, 23 bp, Artificial Sequence
  Description of Artificial Sequence: Synthetic oligonucleotide
tgtctyctactcggttcaggcgg

SEQ ID NO: 1079 - DNA, 23 bp, Artificial Sequence
  Description of Artificial Sequence: Synthetic oligonucleotide
aggyctgtggagtgcaggagagg

SEQ ID NO: 1080 - DNA, 23 bp, Artificial Sequence
  Description of Artificial Sequence: Synthetic oligonucleotide
gccygcagtggagagaggagagg

SEQ ID NO: 1081 - DNA, 23 bp, Artificial Sequence
  Description of Artificial Sequence: Synthetic oligonucleotide
ccgcccyggagacacgaagctgg

SEQ ID NO: 1082 - DNA, 23 bp, Artificial Sequence
  Description of Artificial Sequence: Synthetic oligonucleotide
accygtcgagataatgggtcagg

SEQ ID NO: 1083 - DNA, 23 bp, Artificial Sequence
  Description of Artificial Sequence: Synthetic oligonucleotide
cctctgycatgaagatgtcctgg

SEQ ID NO: 1084 - DNA, 23 bp, Artificial Sequence
  Description of Artificial Sequence: Synthetic oligonucleotide
ctcctgyccccgctccacggtgg

SEQ ID NO: 1085 - DNA, 23 bp, Artificial Sequence
  Description of Artificial Sequence: Synthetic oligonucleotide
gcaygacactgcaggggggtggg

SEQ ID NO: 1086 - DNA, 23 bp, Artificial Sequence
  Description of Artificial Sequence: Synthetic oligonucleotide
cgcaygacactgcaggggggtgg

SEQ ID NO: 1087 - DNA, 23 bp, Artificial Sequence
  Description of Artificial Sequence: Synthetic oligonucleotide
aaccgcaygacactgcagggggg

SEQ ID NO: 1088 - DNA, 23 bp, Artificial Sequence
  Description of Artificial Sequence: Synthetic oligonucleotide
gacycccgtgaaatgattcccgg

SEQ ID NO: 1089 - DNA, 23 bp, Artificial Sequence
  Description of Artificial Sequence: Synthetic oligonucleotide
tcaaccycaccctgtacttcagg

SEQ ID NO: 1090 - DNA, 23 bp, Artificial Sequence
  Description of Artificial Sequence: Synthetic oligonucleotide
gggcyttattccatctctctcgg

SEQ ID NO: 1091 - DNA, 23 bp, Artificial Sequence
  Description of Artificial Sequence: Synthetic oligonucleotide
caggyccagatcgaaatcccggg

SEQ ID NO: 1092 - DNA, 23 bp, Artificial Sequence
  Description of Artificial Sequence: Synthetic oligonucleotide
ccaggyccagatcgaaatcccgg

SEQ ID NO: 1093 - DNA, 23 bp, Artificial Sequence
  Description of Artificial Sequence: Synthetic oligonucleotide
tacttgcygtagaacagaagggg

SEQ ID NO: 1094 - DNA, 23 bp, Artificial Sequence
  Description of Artificial Sequence: Synthetic oligonucleotide
gtcccygtgtcccgcagtctagg

SEQ ID NO: 1095 - DNA, 23 bp, Artificial Sequence
  Description of Artificial Sequence: Synthetic oligonucleotide
tatcaaygaactgtccctcaggg

SEQ ID NO: 1096 - DNA, 23 bp, Artificial Sequence
  Description of Artificial Sequence: Synthetic oligonucleotide
ctatcaaygaactgtccctcagg

SEQ ID NO: 1097 - DNA, 23 bp, Artificial Sequence
  Description of Artificial Sequence: Synthetic oligonucleotide
atgacgyggcctgaatcacaggg

SEQ ID NO: 1098 - DNA, 23 bp, Artificial Sequence
  Description of Artificial Sequence: Synthetic oligonucleotide
aatgacgyggcctgaatcacagg

SEQ ID NO: 1099 - DNA, 23 bp, Artificial Sequence
  Description of Artificial Sequence: Synthetic oligonucleotide
atatccygggggagcagaaaggg

SEQ ID NO: 1100 - DNA, 23 bp, Artificial Sequence
  Description of Artificial Sequence: Synthetic oligonucleotide
gatatccygggggagcagaaagg

SEQ ID NO: 1101 - DNA, 23 bp, Artificial Sequence
  Description of Artificial Sequence: Synthetic oligonucleotide
cagcccaytgataattgggatgg

SEQ ID NO: 1102 - DNA, 23 bp, Artificial Sequence
  Description of Artificial Sequence: Synthetic oligonucleotide
atcyatcaaatacaaaaatttgg

SEQ ID NO: 1103 - DNA, 23 bp, Artificial Sequence
  Description of Artificial Sequence: Synthetic oligonucleotide
cagctcygagaagaaaccacggg

SEQ ID NO: 1104 - DNA, 23 bp, Artificial Sequence
  Description of Artificial Sequence: Synthetic oligonucleotide
tcagctcygagaagaaaccacgg

SEQ ID NO: 1105 - DNA, 23 bp, Artificial Sequence
  Description of Artificial Sequence: Synthetic oligonucleotide
cttcytgctgcggtccccaatgg

SEQ ID NO: 1106 - DNA, 23 bp, Artificial Sequence
  Description of Artificial Sequence: Synthetic oligonucleotide
ttcccygtaagaaaattaacagg

SEQ ID NO: 1107 - DNA, 23 bp, Artificial Sequence
  Description of Artificial Sequence: Synthetic oligonucleotide
gcaccayggctgcgggtcgaggg

SEQ ID NO: 1108 - DNA, 23 bp, Artificial Sequence
  Description of Artificial Sequence: Synthetic oligonucleotide
ggcaccayggctgcgggtcgagg

SEQ ID NO: 1109 - DNA, 23 bp, Artificial Sequence
  Description of Artificial Sequence: Synthetic oligonucleotide
tggcytgtcacccggatatgtgg

SEQ ID NO: 1110 - DNA, 23 bp, Artificial Sequence
  Description of Artificial Sequence: Synthetic oligonucleotide
gaccygcaggcaggagaaggggg

SEQ ID NO: 1111 - DNA, 23 bp, Artificial Sequence
  Description of Artificial Sequence: Synthetic oligonucleotide
tgaccygcaggcaggagaagggg

SEQ ID NO: 1112 - DNA, 23 bp, Artificial Sequence
  Description of Artificial Sequence: Synthetic oligonucleotide
ctgaccygcaggcaggagaaggg

SEQ ID NO: 1113 - DNA, 23 bp, Artificial Sequence
  Description of Artificial Sequence: Synthetic oligonucleotide
gctgaccygcaggcaggagaagg

SEQ ID NO: 1114 - DNA, 23 bp, Artificial Sequence
  Description of Artificial Sequence: Synthetic oligonucleotide
ggaacaygcactcctcttccagg

SEQ ID NO: 1115 - DNA, 23 bp, Artificial Sequence
  Description of Artificial Sequence: Synthetic oligonucleotide
tccygtcatcactctttttgtgg

SEQ ID NO: 1116 - DNA, 23 bp, Artificial Sequence
  Description of Artificial Sequence: Synthetic oligonucleotide
gcggtcaytgaggttctgcatgg

SEQ ID NO: 1117 - DNA, 23 bp, Artificial Sequence
  Description of Artificial Sequence: Synthetic oligonucleotide
aatcytggccccatagcagatgg

SEQ ID NO: 1118 - DNA, 23 bp, Artificial Sequence
  Description of Artificial Sequence: Synthetic oligonucleotide
tccactycttctggctttctggg

SEQ ID NO: 1119 - DNA, 23 bp, Artificial Sequence
  Description of Artificial Sequence: Synthetic oligonucleotide
atccactycttctggctttctgg

SEQ ID NO: 1120 - DNA, 23 bp, Artificial Sequence
  Description of Artificial Sequence: Synthetic oligonucleotide
actttcygttttctgcctctggg

SEQ ID NO: 1121 - DNA, 23 bp, Artificial Sequence
  Description of Artificial Sequence: Synthetic oligonucleotide
cactttcygttttctgcctctgg

SEQ ID NO: 1122 - DNA, 23 bp, Artificial Sequence
  Description of Artificial Sequence: Synthetic oligonucleotide
ggtggyactggaaggggaagtgg

SEQ ID NO: 1123 - DNA, 23 bp, Artificial Sequence
  Description of Artificial Sequence: Synthetic oligonucleotide
ttgycctctgtccaggcatctgg

SEQ ID NO: 1124 - DNA, 23 bp, Artificial Sequence
  Description of Artificial Sequence: Synthetic oligonucleotide
cgcyctcgtaccctgtgctgtgg

SEQ ID NO: 1125 - DNA, 23 bp, Artificial Sequence
  Description of Artificial Sequence: Synthetic oligonucleotide
gtggygcccgaggtgcccattgg

SEQ ID NO: 1126 - DNA, 23 bp, Artificial Sequence
  Description of Artificial Sequence: Synthetic oligonucleotide
ttayacaaaacaatgttgagtgg

SEQ ID NO: 1127 - DNA, 23 bp, Artificial Sequence
  Description of Artificial Sequence: Synthetic oligonucleotide
acaatyccagctggctgggctgg

SEQ ID NO: 1128 - DNA, 23 bp, Artificial Sequence
  Description of Artificial Sequence: Synthetic oligonucleotide
cggytctggaaccagacctgggg

SEQ ID NO: 1129 - DNA, 23 bp, Artificial Sequence
  Description of Artificial Sequence: Synthetic oligonucleotide
gcggytctggaaccagacctggg

SEQ ID NO: 1130 - DNA, 23 bp, Artificial Sequence
  Description of Artificial Sequence: Synthetic oligonucleotide
tgcggytctggaaccagacctgg

SEQ ID NO: 1131 - DNA, 23 bp, Artificial Sequence
  Description of Artificial Sequence: Synthetic oligonucleotide
cccayggctgcggctggcggcgg

SEQ ID NO: 1132 - DNA, 23 bp, Artificial Sequence
  Description of Artificial Sequence: Synthetic oligonucleotide
cggcccayggctgcggctggcgg

SEQ ID NO: 1133 - DNA, 23 bp, Artificial Sequence
  Description of Artificial Sequence: Synthetic oligonucleotide
aagtcayagtgcacggcacaagg

SEQ ID NO: 1134 - DNA, 23 bp, Artificial Sequence
  Description of Artificial Sequence: Synthetic oligonucleotide
aagcygctctgagggctcccagg

SEQ ID NO: 1135 - DNA, 23 bp, Artificial Sequence
  Description of Artificial Sequence: Synthetic oligonucleotide
gtgygatcatgtaatggcgccgg

SEQ ID NO: 1136 - DNA, 23 bp, Artificial Sequence
  Description of Artificial Sequence: Synthetic oligonucleotide
cctgaccytgtcggagctccggg

SEQ ID NO: 1137 - DNA, 23 bp, Artificial Sequence
  Description of Artificial Sequence: Synthetic oligonucleotide
gccacacyctctgccttgcccgg

SEQ ID NO: 1138 - DNA, 23 bp, Artificial Sequence
  Description of Artificial Sequence: Synthetic oligonucleotide
gggtcygcatttgtccgtggagg

SEQ ID NO: 1139 - DNA, 23 bp, Artificial Sequence
  Description of Artificial Sequence: Synthetic oligonucleotide
cgctctyggcaaagaacgctggg

SEQ ID NO: 1140 - DNA, 23 bp, Artificial Sequence
  Description of Artificial Sequence: Synthetic oligonucleotide
gcgctctyggcaaagaacgctgg

SEQ ID NO: 1141 - DNA, 23 bp, Artificial Sequence
  Description of Artificial Sequence: Synthetic oligonucleotide
agactttyctgcttaaagaaggg

SEQ ID NO: 1142 - DNA, 23 bp, Artificial Sequence
  Description of Artificial Sequence: Synthetic oligonucleotide
ccttttcytgtgtatttgattgg

SEQ ID NO: 1143 - DNA, 23 bp, Artificial Sequence
  Description of Artificial Sequence: Synthetic oligonucleotide
gacacgyctgtgtagtgcacagg

SEQ ID NO: 1144 - DNA, 23 bp, Artificial Sequence
  Description of Artificial Sequence: Synthetic oligonucleotide
actycttctctttctcctgaggg

SEQ ID NO: 1145 - DNA, 23 bp, Artificial Sequence
  Description of Artificial Sequence: Synthetic oligonucleotide
tactycttctctttctcctgagg

SEQ ID NO: 1146 - DNA, 23 bp, Artificial Sequence
  Description of Artificial Sequence: Synthetic oligonucleotide
gcccayagtgtccagagacctgg

SEQ ID NO: 1147 - DNA, 23 bp, Artificial Sequence
  Description of Artificial Sequence: Synthetic oligonucleotide
ataycaccacacacaggtaacgg

SEQ ID NO: 1148 - DNA, 23 bp, Artificial Sequence
  Description of Artificial Sequence: Synthetic oligonucleotide
tggytgcacagacagtacgtggg

SEQ ID NO: 1149 - DNA, 23 bp, Artificial Sequence
  Description of Artificial Sequence: Synthetic oligonucleotide
ctggytgcacagacagtacgtgg

SEQ ID NO: 1150 - DNA, 23 bp, Artificial Sequence
  Description of Artificial Sequence: Synthetic oligonucleotide
gatcaycttcatgtagggcaggg

SEQ ID NO: 1151 - DNA, 23 bp, Artificial Sequence
  Description of Artificial Sequence: Synthetic oligonucleotide
agatcaycttcatgtagggcagg

SEQ ID NO: 1152 - DNA, 23 bp, Artificial Sequence
  Description of Artificial Sequence: Synthetic oligonucleotide
ccayccaaccctaagagaagagg

SEQ ID NO: 1153 - DNA, 23 bp, Artificial Sequence
  Description of Artificial Sequence: Synthetic oligonucleotide
tgaccgygatctgcagagaaggg

SEQ ID NO: 1154 - DNA, 23 bp, Artificial Sequence
  Description of Artificial Sequence: Synthetic oligonucleotide
ctgaccgygatctgcagagaagg

SEQ ID NO: 1155 - DNA, 23 bp, Artificial Sequence
  Description of Artificial Sequence: Synthetic oligonucleotide
gctcaygaagaagatgttctggg

SEQ ID NO: 1156 - DNA, 23 bp, Artificial Sequence
  Description of Artificial Sequence: Synthetic oligonucleotide
tgctcaygaagaagatgttctgg

SEQ ID NO: 1157 - DNA, 23 bp, Artificial Sequence
  Description of Artificial Sequence: Synthetic oligonucleotide
caacyccactttagagcgaaagg

SEQ ID NO: 1158 - DNA, 23 bp, Artificial Sequence
  Description of Artificial Sequence: Synthetic oligonucleotide
cccactyggctcaagaccaatgg

SEQ ID NO: 1159 - DNA, 23 bp, Artificial Sequence
  Description of Artificial Sequence: Synthetic oligonucleotide
ctgcyctccacgtcgccccgggg

SEQ ID NO: 1160 - DNA, 23 bp, Artificial Sequence
  Description of Artificial Sequence: Synthetic oligonucleotide
cctgcyctccacgtcgccccggg

SEQ ID NO: 1161 - DNA, 23 bp, Artificial Sequence
  Description of Artificial Sequence: Synthetic oligonucleotide
gcctgcyctccacgtcgccccgg

SEQ ID NO: 1162 - DNA, 23 bp, Artificial Sequence
  Description of Artificial Sequence: Synthetic oligonucleotide
ggaccygcacccggggaaggcgg

SEQ ID NO: 1163 - DNA, 23 bp, Artificial Sequence
  Description of Artificial Sequence: Synthetic oligonucleotide
agagctayagtgttcctaaaagg

SEQ ID NO: 1164 - DNA, 23 bp, Artificial Sequence
  Description of Artificial Sequence: Synthetic oligonucleotide
tgaatycctaaggaagagactgg

SEQ ID NO: 1165 - DNA, 23 bp, Artificial Sequence
  Description of Artificial Sequence: Synthetic oligonucleotide
agcygcaggggcacagggatggg

SEQ ID NO: 1166 - DNA, 23 bp, Artificial Sequence
  Description of Artificial Sequence: Synthetic oligonucleotide
aagcygcaggggcacagggatgg

SEQ ID NO: 1167 - DNA, 23 bp, Artificial Sequence
  Description of Artificial Sequence: Synthetic oligonucleotide
agaatctycaatagacacatcgg

SEQ ID NO: 1168 - DNA, 23 bp, Artificial Sequence
  Description of Artificial Sequence: Synthetic oligonucleotide
atcytgtcatcatcatcaaaggg

SEQ ID NO: 1169 - DNA, 23 bp, Artificial Sequence
  Description of Artificial Sequence: Synthetic oligonucleotide
gatcytgtcatcatcatcaaagg

SEQ ID NO: 1170 - DNA, 23 bp, Artificial Sequence
  Description of Artificial Sequence: Synthetic oligonucleotide
tcatcygtttgcctgctaagcgg

SEQ ID NO: 1171 - DNA, 23 bp, Artificial Sequence
  Description of Artificial Sequence: Synthetic oligonucleotide
ccgacyccaccttgggcagctgg

SEQ ID NO: 1172 - DNA, 23 bp, Artificial Sequence
  Description of Artificial Sequence: Synthetic oligonucleotide
attcayatctgcctccatgttgg

SEQ ID NO: 1173 - DNA, 23 bp, Artificial Sequence
  Description of Artificial Sequence: Synthetic oligonucleotide
attcaccyaccgacaaggatagg

SEQ ID NO: 1174 - DNA, 23 bp, Artificial Sequence
  Description of Artificial Sequence: Synthetic oligonucleotide
gaagtcgytgtcaaacaggaagg

SEQ ID NO: 1175 - DNA, 23 bp, Artificial Sequence
  Description of Artificial Sequence: Synthetic oligonucleotide
tgacctyactgggtggtgacggg

SEQ ID NO: 1176 - DNA, 23 bp, Artificial Sequence
  Description of Artificial Sequence: Synthetic oligonucleotide
atgacctyactgggtggtgacgg

SEQ ID NO: 1177 - DNA, 23 bp, Artificial Sequence
  Description of Artificial Sequence: Synthetic oligonucleotide
cagcygccaatggttccagttgg

SEQ ID NO: 1178 - DNA, 23 bp, Artificial Sequence
  Description of Artificial Sequence: Synthetic oligonucleotide
cctccyccccagactgaagccgg

SEQ ID NO: 1179 - DNA, 23 bp, Artificial Sequence
  Description of Artificial Sequence: Synthetic oligonucleotide
caccytggggacaccaggtcggg

SEQ ID NO: 1180 - DNA, 23 bp, Artificial Sequence
  Description of Artificial Sequence: Synthetic oligonucleotide
tcaccytggggacaccaggtcgg

SEQ ID NO: 1181 - DNA, 23 bp, Artificial Sequence
  Description of Artificial Sequence: Synthetic oligonucleotide
ccaactyacgagccacctacagg

SEQ ID NO: 1182 - DNA, 23 bp, Artificial Sequence
  Description of Artificial Sequence: Synthetic oligonucleotide
atcyctcagcaaactcagcacgg

SEQ ID NO: 1183 - DNA, 23 bp, Artificial Sequence
  Description of Artificial Sequence: Synthetic oligonucleotide
cctcyctcaccacgttgcccagg

SEQ ID NO: 1184 - DNA, 23 bp, Artificial Sequence
  Description of Artificial Sequence: Synthetic oligonucleotide
ataggcayagatattgtcccagg

SEQ ID NO: 1185 - DNA, 23 bp, Artificial Sequence
  Description of Artificial Sequence: Synthetic oligonucleotide
gctgyggcaacagaggccttcgg

SEQ ID NO: 1186 - DNA, 23 bp, Artificial Sequence
  Description of Artificial Sequence: Synthetic oligonucleotide
acttaycctggggagaaggatgg

SEQ ID NO: 1187 - DNA, 23 bp, Artificial Sequence
  Description of Artificial Sequence: Synthetic oligonucleotide
agaaycattcttgatgtctctgg

SEQ ID NO: 1188 - DNA, 23 bp, Artificial Sequence
  Description of Artificial Sequence: Synthetic oligonucleotide
gttcytaccacttaaagacgagg

SEQ ID NO: 1189 - DNA, 23 bp, Artificial Sequence
  Description of Artificial Sequence: Synthetic oligonucleotide
ttcttcgyggactgcaaacaagg

SEQ ID NO: 1190 - DNA, 23 bp, Artificial Sequence
  Description of Artificial Sequence: Synthetic oligonucleotide
agcaacygcagaaaaaagagggg

SEQ ID NO: 1191 - DNA, 23 bp, Artificial Sequence
  Description of Artificial Sequence: Synthetic oligonucleotide
cagcaacygcagaaaaaagaggg

SEQ ID NO: 1192 - DNA, 23 bp, Artificial Sequence
  Description of Artificial Sequence: Synthetic oligonucleotide
ccaccygaggcaggggcggcagg

SEQ ID NO: 1193 - DNA, 23 bp, Artificial Sequence
  Description of Artificial Sequence: Synthetic oligonucleotide
cgttacygaaactcctgtgtagg

SEQ ID NO: 1194 - DNA, 23 bp, Artificial Sequence
  Description of Artificial Sequence: Synthetic oligonucleotide
cgttcccygaggcaaaagagggg

SEQ ID NO: 1195 - DNA, 23 bp, Artificial Sequence
  Description of Artificial Sequence: Synthetic oligonucleotide
acttycccctaggcggaaagggg

SEQ ID NO: 1196 - DNA, 23 bp, Artificial Sequence
  Description of Artificial Sequence: Synthetic oligonucleotide
gacttycccctaggcggaaaggg

SEQ ID NO: 1197 - DNA, 23 bp, Artificial Sequence
  Description of Artificial Sequence: Synthetic oligonucleotide
ggacttycccctaggcggaaagg

SEQ ID NO: 1198 - DNA, 23 bp, Artificial Sequence
  Description of Artificial Sequence: Synthetic oligonucleotide
ctcyctgccacgtaatacagggg

SEQ ID NO: 1199 - DNA, 23 bp, Artificial Sequence
  Description of Artificial Sequence: Synthetic oligonucleotide
actcyctgccacgtaatacaggg

SEQ ID NO: 1200 - DNA, 23 bp, Artificial Sequence
  Description of Artificial Sequence: Synthetic oligonucleotide
aactcyctgccacgtaatacagg

SEQ ID NO: 1201 - DNA, 23 bp, Artificial Sequence
  Description of Artificial Sequence: Synthetic oligonucleotide
gggtcgyagcgaactgagaaggg

SEQ ID NO: 1202 - DNA, 23 bp, Artificial Sequence
  Description of Artificial Sequence: Synthetic oligonucleotide
tgggtcgyagcgaactgagaagg

SEQ ID NO: 1203 - DNA, 23 bp, Artificial Sequence
  Description of Artificial Sequence: Synthetic oligonucleotide
ggatgycctgctcggtgggctgg

SEQ ID NO: 1204 - DNA, 23 bp, Artificial Sequence
  Description of Artificial Sequence: Synthetic oligonucleotide
ccgcayggggccgaagtctgggg

SEQ ID NO: 1205 - DNA, 23 bp, Artificial Sequence
  Description of Artificial Sequence: Synthetic oligonucleotide
gccgcayggggccgaagtctggg

SEQ ID NO: 1206 - DNA, 23 bp, Artificial Sequence
  Description of Artificial Sequence: Synthetic oligonucleotide
agccgcayggggccgaagtctgg

SEQ ID NO: 1207 - DNA, 23 bp, Artificial Sequence
  Description of Artificial Sequence: Synthetic oligonucleotide
gtacttgyagtcggggtagtcgg

SEQ ID NO: 1208 - DNA, 23 bp, Artificial Sequence
  Description of Artificial Sequence: Synthetic oligonucleotide
ttgytcccccctcggcctcaggg

SEQ ID NO: 1209 - DNA, 23 bp, Artificial Sequence
  Description of Artificial Sequence: Synthetic oligonucleotide
attgytcccccctcggcctcagg

SEQ ID NO: 1210 - DNA, 23 bp, Artificial Sequence
  Description of Artificial Sequence: Synthetic oligonucleotide
ctccyggtgctgaaggacttggg

SEQ ID NO: 1211 - DNA, 23 bp, Artificial Sequence
  Description of Artificial Sequence: Synthetic oligonucleotide
gctccyggtgctgaaggacttgg

SEQ ID NO: 1212 - DNA, 23 bp, Artificial Sequence
  Description of Artificial Sequence: Synthetic oligonucleotide
aatcaygatgtacatccttctgg

SEQ ID NO: 1213 - DNA, 23 bp, Artificial Sequence
  Description of Artificial Sequence: Synthetic oligonucleotide
gataycggtttcattaaggtagg

SEQ ID NO: 1214 - DNA, 23 bp, Artificial Sequence
  Description of Artificial Sequence: Synthetic oligonucleotide
ccacgygctgcgctggctggagg

SEQ ID NO: 1215 - DNA, 23 bp, Artificial Sequence
  Description of Artificial Sequence: Synthetic oligonucleotide
acttcycaccgggtagctcccgg

SEQ ID NO: 1216 - DNA, 23 bp, Artificial Sequence
  Description of Artificial Sequence: Synthetic oligonucleotide
gcayactggcggatggtccaggg

SEQ ID NO: 1217 - DNA, 23 bp, Artificial Sequence
  Description of Artificial Sequence: Synthetic oligonucleotide
agcayactggcggatggtccagg

SEQ ID NO: 1218 - DNA, 23 bp, Artificial Sequence
  Description of Artificial Sequence: Synthetic oligonucleotide
gttccyggaaagcattaagaagg

SEQ ID NO: 1219 - DNA, 23 bp, Artificial Sequence
  Description of Artificial Sequence: Synthetic oligonucleotide
tagcaygaagacggtgaagacgg

SEQ ID NO: 1220 - DNA, 23 bp, Artificial Sequence
  Description of Artificial Sequence: Synthetic oligonucleotide
cgtacyggcggatgccttcccgg

SEQ ID NO: 1221 - DNA, 23 bp, Artificial Sequence
  Description of Artificial Sequence: Synthetic oligonucleotide
aggcccygaggaagcagggacgg

SEQ ID NO: 1222 - DNA, 23 bp, Artificial Sequence
  Description of Artificial Sequence: Synthetic oligonucleotide
ctcayggcacttacctgggatgg

SEQ ID NO: 1223 - DNA, 23 bp, Artificial Sequence
  Description of Artificial Sequence: Synthetic oligonucleotide
tcacagcygcggggaaagggagg

SEQ ID NO: 1224 - DNA, 23 bp, Artificial Sequence
  Description of Artificial Sequence: Synthetic oligonucleotide
ggtaccyggaagacacgaggggg

SEQ ID NO: 1225 - DNA, 23 bp, Artificial Sequence
  Description of Artificial Sequence: Synthetic oligonucleotide
tggtaccyggaagacacgagggg

SEQ ID NO: 1226 - DNA, 23 bp, Artificial Sequence
  Description of Artificial Sequence: Synthetic oligonucleotide
tgccaytgtaattcccacacagg

SEQ ID NO: 1227 - DNA, 23 bp, Artificial Sequence
  Description of Artificial Sequence: Synthetic oligonucleotide
attycaatggcttctgggtctgg

SEQ ID NO: 1228 - DNA, 23 bp, Artificial Sequence
  Description of Artificial Sequence: Synthetic oligonucleotide
atayctggccgcgcttccccagg

SEQ ID NO: 1229 - DNA, 23 bp, Artificial Sequence
  Description of Artificial Sequence: Synthetic oligonucleotide
cgctcaygctgcaggctggacgg

SEQ ID NO: 1230 - DNA, 23 bp, Artificial Sequence
  Description of Artificial Sequence: Synthetic oligonucleotide
gtacytgtccccgtagccaatgg

SEQ ID NO: 1231 - DNA, 23 bp, Artificial Sequence
  Description of Artificial Sequence: Synthetic oligonucleotide
gataycatacaggaatgctgggg

SEQ ID NO: 1232 - DNA, 23 bp, Artificial Sequence
  Description of Artificial Sequence: Synthetic oligonucleotide
agataycatacaggaatgctggg

SEQ ID NO: 1233 - DNA, 23 bp, Artificial Sequence
  Description of Artificial Sequence: Synthetic oligonucleotide
tagataycatacaggaatgctgg

SEQ ID NO: 1234 - DNA, 23 bp, Artificial Sequence
  Description of Artificial Sequence: Synthetic oligonucleotide
cacccyaaagaagaagtggtcgg

SEQ ID NO: 1235 - DNA, 23 bp, Artificial Sequence
  Description of Artificial Sequence: Synthetic oligonucleotide
tttacagygggctctagaggggg

SEQ ID NO: 1236 - DNA, 23 bp, Artificial Sequence
  Description of Artificial Sequence: Synthetic oligonucleotide
ctgycttccttcacctctgctgg

SEQ ID NO: 1237 - DNA, 23 bp, Artificial Sequence
  Description of Artificial Sequence: Synthetic oligonucleotide
agccytgggaaggggggcagcgg

SEQ ID NO: 1238 - DNA, 23 bp, Artificial Sequence
  Description of Artificial Sequence: Synthetic oligonucleotide
ggcccggytggtgtaatacacgg

SEQ ID NO: 1239 - DNA, 23 bp, Artificial Sequence
  Description of Artificial Sequence: Synthetic oligonucleotide
gtatcygggagataggacagagg

SEQ ID NO: 1240 - DNA, 23 bp, Artificial Sequence
  Description of Artificial Sequence: Synthetic oligonucleotide
gcaccayggtgcctggcgggagg

SEQ ID NO: 1241 - DNA, 23 bp, Artificial Sequence
  Description of Artificial Sequence: Synthetic oligonucleotide
agatcyccactgtggttgcctgg

SEQ ID NO: 1242 - DNA, 23 bp, Artificial Sequence
  Description of Artificial Sequence: Synthetic oligonucleotide
aggcccaytgccatacaggatgg

SEQ ID NO: 1243 - DNA, 23 bp, Artificial Sequence
  Description of Artificial Sequence: Synthetic oligonucleotide
gcagyccacccacagccccatgg

SEQ ID NO: 1244 - DNA, 23 bp, Artificial Sequence
  Description of Artificial Sequence: Synthetic oligonucleotide
cggcaayggtgtagcggcggggg

SEQ ID NO: 1245 - DNA, 23 bp, Artificial Sequence
  Description of Artificial Sequence: Synthetic oligonucleotide
gcggcaayggtgtagcggcgggg

SEQ ID NO: 1246 - DNA, 23 bp, Artificial Sequence
  Description of Artificial Sequence: Synthetic oligonucleotide
cgactyggagagacgcctgcagg

SEQ ID NO: 1247 - DNA, 23 bp, Artificial Sequence
  Description of Artificial Sequence: Synthetic oligonucleotide
atatcayctagagggaagggggg

SEQ ID NO: 1248 - DNA, 23 bp, Artificial Sequence
  Description of Artificial Sequence: Synthetic oligonucleotide
catatcayctagagggaaggggg

SEQ ID NO: 1249 - DNA, 23 bp, Artificial Sequence
  Description of Artificial Sequence: Synthetic oligonucleotide
cgccagcygcatttcaaagatgg

SEQ ID NO: 1250 - DNA, 23 bp, Artificial Sequence
  Description of Artificial Sequence: Synthetic oligonucleotide
tagcayatttgcaacaagcttgg

SEQ ID NO: 1251 - DNA, 23 bp, Artificial Sequence
  Description of Artificial Sequence: Synthetic oligonucleotide
gcgggyacttggtgtggatgagg

SEQ ID NO: 1252 - DNA, 23 bp, Artificial Sequence
  Description of Artificial Sequence: Synthetic oligonucleotide
ctgycagggtcaggcacacctgg

SEQ ID NO: 1253 - DNA, 23 bp, Artificial Sequence
  Description of Artificial Sequence: Synthetic oligonucleotide
gcagaccygcacaaaatacaagg

SEQ ID NO: 1254 - DNA, 23 bp, Artificial Sequence
  Description of Artificial Sequence: Synthetic oligonucleotide
cttcaygtgcaggaagcggctgg

SEQ ID NO: 1255 - DNA, 23 bp, Artificial Sequence
  Description of Artificial Sequence: Synthetic oligonucleotide
ccacctycatgtgcaggaagcgg

SEQ ID NO: 1256 - DNA, 23 bp, Artificial Sequence
  Description of Artificial Sequence: Synthetic oligonucleotide
ccgttcygtgggtatagagtggg

SEQ ID NO: 1257 - DNA, 23 bp, Artificial Sequence
  Description of Artificial Sequence: Synthetic oligonucleotide
gccgttcygtgggtatagagtgg

SEQ ID NO: 1258 - DNA, 23 bp, Artificial Sequence
  Description of Artificial Sequence: Synthetic oligonucleotide
ctttcygttgaaataaggatggg

SEQ ID NO: 1259 - DNA, 23 bp, Artificial Sequence
  Description of Artificial Sequence: Synthetic oligonucleotide
tctttcygttgaaataaggatgg

SEQ ID NO: 1260 - DNA, 23 bp, Artificial Sequence
  Description of Artificial Sequence: Synthetic oligonucleotide
ggtcttyctgcacatttgggtgg

SEQ ID NO: 1261 - DNA, 23 bp, Artificial Sequence
  Description of Artificial Sequence: Synthetic oligonucleotide
gtgaaccygaaatgagagggagg

SEQ ID NO: 1262 - DNA, 23 bp, Artificial Sequence
  Description of Artificial Sequence: Synthetic oligonucleotide
gtaccygggtgggggccgcaggg

SEQ ID NO: 1263 - DNA, 23 bp, Artificial Sequence
  Description of Artificial Sequence: Synthetic oligonucleotide
tgtaccygggtgggggccgcagg

SEQ ID NO: 1264 - DNA, 23 bp, Artificial Sequence
  Description of Artificial Sequence: Synthetic oligonucleotide
tcayctttcatgggctcttttgg

SEQ ID NO: 1265 - DNA, 23 bp, Artificial Sequence
  Description of Artificial Sequence: Synthetic oligonucleotide
tatttyacatagttggaatgtgg

SEQ ID NO: 1266 - DNA, 23 bp, Artificial Sequence
  Description of Artificial Sequence: Synthetic oligonucleotide
ggccaayttcctgtaattggggg

SEQ ID NO: 1267 - DNA, 23 bp, Artificial Sequence
  Description of Artificial Sequence: Synthetic oligonucleotide
aggccaayttcctgtaattgggg

SEQ ID NO: 1268 - DNA, 23 bp, Artificial Sequence
  Description of Artificial Sequence: Synthetic oligonucleotide
tccayggcgggtgcgggctcagg

SEQ ID NO: 1269 - DNA, 23 bp, Artificial Sequence
  Description of Artificial Sequence: Synthetic oligonucleotide
aggcgtygaccagcgagtacagg

SEQ ID NO: 1270 - DNA, 23 bp, Artificial Sequence
  Description of Artificial Sequence: Synthetic oligonucleotide
gcccycctcgtgctccagggagg

SEQ ID NO: 1271 - DNA, 23 bp, Artificial Sequence
  Description of Artificial Sequence: Synthetic oligonucleotide
cttgcccycctcgtgctccaggg

SEQ ID NO: 1272 - DNA, 23 bp, Artificial Sequence
  Description of Artificial Sequence: Synthetic oligonucleotide
tgatcaygcagtgtccagaaggg

SEQ ID NO: 1273 - DNA, 23 bp, Artificial Sequence
  Description of Artificial Sequence: Synthetic oligonucleotide
gtgatcaygcagtgtccagaagg

SEQ ID NO: 1274 - DNA, 23 bp, Artificial Sequence
  Description of Artificial Sequence: Synthetic oligonucleotide
gtacyggtcatagggcagcatgg

SEQ ID NO: 1275 - DNA, 23 bp, Artificial Sequence
  Description of Artificial Sequence: Synthetic oligonucleotide
ttccttcyggacagcagaagagg

SEQ ID NO: 1276 - DNA, 23 bp, Artificial Sequence
  Description of Artificial Sequence: Synthetic oligonucleotide
gctgcygccctcgcaccactggg

SEQ ID NO: 1277 - DNA, 23 bp, Artificial Sequence
  Description of Artificial Sequence: Synthetic oligonucleotide
ggctgcygccctcgcaccactgg

SEQ ID NO: 1278 - DNA, 23 bp, Artificial Sequence
  Description of Artificial Sequence: Synthetic oligonucleotide
aagctcygaggtcctgggggagg

SEQ ID NO: 1279 - DNA, 23 bp, Artificial Sequence
  Description of Artificial Sequence: Synthetic oligonucleotide
tacycatggtgactcaagcctgg

SEQ ID NO: 1280 - DNA, 23 bp, Artificial Sequence
  Description of Artificial Sequence: Synthetic oligonucleotide
gcagcccyaggaagtccagaagg

SEQ ID NO: 1281 - DNA, 23 bp, Artificial Sequence
  Description of Artificial Sequence: Synthetic oligonucleotide
agccyacgggaaaagaactgtgg

SEQ ID NO: 1282 - DNA, 23 bp, Artificial Sequence
  Description of Artificial Sequence: Synthetic oligonucleotide
aggtatcygaaacagaaggttgg

SEQ ID NO: 1283 - DNA, 23 bp, Artificial Sequence
  Description of Artificial Sequence: Synthetic oligonucleotide
gaatcgtyctgcaggagaggggg

SEQ ID NO: 1284 - DNA, 23 bp, Artificial Sequence
  Description of Artificial Sequence: Synthetic oligonucleotide
caggtacygcacatctagactgg

SEQ ID NO: 1285 - DNA, 23 bp, Artificial Sequence
  Description of Artificial Sequence: Synthetic oligonucleotide
gttattcyccaatggtgattggg

SEQ ID NO: 1286 - DNA, 23 bp, Artificial Sequence
  Description of Artificial Sequence: Synthetic oligonucleotide
tcatcayctgaggcacgatacgg

SEQ ID NO: 1287 - DNA, 23 bp, Artificial Sequence
  Description of Artificial Sequence: Synthetic oligonucleotide
tgctacaytacctgaggtacagg

SEQ ID NO: 1288 - DNA, 23 bp, Artificial Sequence
  Description of Artificial Sequence: Synthetic oligonucleotide
cacgytcaccttgccccacaggg

SEQ ID NO: 1289 - DNA, 23 bp, Artificial Sequence
  Description of Artificial Sequence: Synthetic oligonucleotide
ccacgytcaccttgccccacagg

SEQ ID NO: 1290 - DNA, 23 bp, Artificial Sequence
  Description of Artificial Sequence: Synthetic oligonucleotide
acacaygtagttgtagtggatgg

SEQ ID NO: 1291 - DNA, 23 bp, Artificial Sequence
  Description of Artificial Sequence: Synthetic oligonucleotide
ggcttgyctgggatggtcacagg

SEQ ID NO: 1292 - DNA, 23 bp, Artificial Sequence
  Description of Artificial Sequence: Synthetic oligonucleotide
gatcaygatggtgatgtcgaagg

SEQ ID NO: 1293 - DNA, 23 bp, Artificial Sequence
  Description of Artificial Sequence: Synthetic oligonucleotide
ccatcayggtgaccatgttgagg

SEQ ID NO: 1294 - DNA, 23 bp, Artificial Sequence
  Description of Artificial Sequence: Synthetic oligonucleotide
tgtacaygttgaccacgatgagg

SEQ ID NO: 1295 - DNA, 23 bp, Artificial Sequence
  Description of Artificial Sequence: Synthetic oligonucleotide
tatgyccagctgctgtaacctgg

SEQ ID NO: 1296 - DNA, 23 bp, Artificial Sequence
  Description of Artificial Sequence: Synthetic oligonucleotide
gatctcgyagtaggatgccatgg

SEQ ID NO: 1297 - DNA, 23 bp, Artificial Sequence
  Description of Artificial Sequence: Synthetic oligonucleotide
gcaycacaaaattgtacctgggg

SEQ ID NO: 1298 - DNA, 23 bp, Artificial Sequence
  Description of Artificial Sequence: Synthetic oligonucleotide
agcaycacaaaattgtacctggg

SEQ ID NO: 1299 - DNA, 23 bp, Artificial Sequence
  Description of Artificial Sequence: Synthetic oligonucleotide
cagcaycacaaaattgtacctgg

SEQ ID NO: 1300 - DNA, 23 bp, Artificial Sequence
  Description of Artificial Sequence: Synthetic oligonucleotide
aaccygtatgagaaaacaatggg

SEQ ID NO: 1301 - DNA, 23 bp, Artificial Sequence
  Description of Artificial Sequence: Synthetic oligonucleotide
taaccygtatgagaaaacaatgg

SEQ ID NO: 1302 - DNA, 23 bp, Artificial Sequence
  Description of Artificial Sequence: Synthetic oligonucleotide
agccygtgcaaacaggggaatgg

SEQ ID NO: 1303 - DNA, 23 bp, Artificial Sequence
  Description of Artificial Sequence: Synthetic oligonucleotide
ggctcygggggcagagtcagggg

SEQ ID NO: 1304 - DNA, 23 bp, Artificial Sequence
  Description of Artificial Sequence: Synthetic oligonucleotide
gggctcygggggcagagtcaggg

SEQ ID NO: 1305 - DNA, 23 bp, Artificial Sequence
  Description of Artificial Sequence: Synthetic oligonucleotide
agggctcygggggcagagtcagg

SEQ ID NO: 1306 - DNA, 23 bp, Artificial Sequence
  Description of Artificial Sequence: Synthetic oligonucleotide
ccgccaycagcgtgtcgccacgg

SEQ ID NO: 1307 - DNA, 23 bp, Artificial Sequence
  Description of Artificial Sequence: Synthetic oligonucleotide
atgyccacggactttccataggg

SEQ ID NO: 1308 - DNA, 23 bp, Artificial Sequence
  Description of Artificial Sequence: Synthetic oligonucleotide
catgyccacggactttccatagg

SEQ ID NO: 1309 - DNA, 23 bp, Artificial Sequence
  Description of Artificial Sequence: Synthetic oligonucleotide
acacacayattcatcatcatggg

SEQ ID NO: 1310 - DNA, 23 bp, Artificial Sequence
  Description of Artificial Sequence: Synthetic oligonucleotide
ttaccyggcagtgggggtggggg

SEQ ID NO: 1311 - DNA, 23 bp, Artificial Sequence
  Description of Artificial Sequence: Synthetic oligonucleotide
cttaccyggcagtgggggtgggg

SEQ ID NO: 1312 - DNA, 23 bp, Artificial Sequence
  Description of Artificial Sequence: Synthetic oligonucleotide
ccttaccyggcagtgggggtggg

SEQ ID NO: 1313 - DNA, 23 bp, Artificial Sequence
  Description of Artificial Sequence: Synthetic oligonucleotide
ttctcccyggaacacaaaacagg

SEQ ID NO: 1314 - DNA, 23 bp, Artificial Sequence
  Description of Artificial Sequence: Synthetic oligonucleotide
gcagttcygtgggggaatgaagg

SEQ ID NO: 1315 - DNA, 23 bp, Artificial Sequence
  Description of Artificial Sequence: Synthetic oligonucleotide
cccacyggggagaagggcagggg

SEQ ID NO: 1316 - DNA, 23 bp, Artificial Sequence
  Description of Artificial Sequence: Synthetic oligonucleotide
gcccacyggggagaagggcaggg

SEQ ID NO: 1317 - DNA, 23 bp, Artificial Sequence
  Description of Artificial Sequence: Synthetic oligonucleotide
ggcccacyggggagaagggcagg

SEQ ID NO: 1318 - DNA, 23 bp, Artificial Sequence
  Description of Artificial Sequence: Synthetic oligonucleotide
cagagcayagaccaagaaaaagg

SEQ ID NO: 1319 - DNA, 23 bp, Artificial Sequence
  Description of Artificial Sequence: Synthetic oligonucleotide
tcaacayaatatttctaggcagg

SEQ ID NO: 1320 - DNA, 23 bp, Artificial Sequence
  Description of Artificial Sequence: Synthetic oligonucleotide
aagyctcaggattggtccgaagg

SEQ ID NO: 1321 - DNA, 23 bp, Artificial Sequence
  Description of Artificial Sequence: Synthetic oligonucleotide
ctayactcccagcctgggggagg

SEQ ID NO: 1322 - DNA, 23 bp, Artificial Sequence
  Description of Artificial Sequence: Synthetic oligonucleotide
atgctayactcccagcctggggg

SEQ ID NO: 1323 - DNA, 23 bp, Artificial Sequence
  Description of Artificial Sequence: Synthetic oligonucleotide
gatgctayactcccagcctgggg

SEQ ID NO: 1324 - DNA, 23 bp, Artificial Sequence
  Description of Artificial Sequence: Synthetic oligonucleotide
tctygaaccaaacctgggggcgg

SEQ ID NO: 1325 - DNA, 23 bp, Artificial Sequence
  Description of Artificial Sequence: Synthetic oligonucleotide
gattctygaaccaaacctggggg

SEQ ID NO: 1326 - DNA, 23 bp, Artificial Sequence
  Description of Artificial Sequence: Synthetic oligonucleotide
cgattctygaaccaaacctgggg

SEQ ID NO: 1327 - DNA, 23 bp, Artificial Sequence
  Description of Artificial Sequence: Synthetic oligonucleotide
agtgcytgtccagctcgggtggg

SEQ ID NO: 1328 - DNA, 23 bp, Artificial Sequence
  Description of Artificial Sequence: Synthetic oligonucleotide
aagtgcytgtccagctcgggtgg

SEQ ID NO: 1329 - DNA, 23 bp, Artificial Sequence
  Description of Artificial Sequence: Synthetic oligonucleotide
ttccyggggccagcagagaaggg

SEQ ID NO: 1330 - DNA, 23 bp, Artificial Sequence
  Description of Artificial Sequence: Synthetic oligonucleotide
gttccyggggccagcagagaagg

SEQ ID NO: 1331 - DNA, 23 bp, Artificial Sequence
  Description of Artificial Sequence: Synthetic oligonucleotide
caccygagtaagataaagaaagg

SEQ ID NO: 1332 - DNA, 23 bp, Artificial Sequence
  Description of Artificial Sequence: Synthetic oligonucleotide
acccyaaaagaagccatcaatgg

SEQ ID NO: 1333 - DNA, 23 bp, Artificial Sequence
  Description of Artificial Sequence: Synthetic oligonucleotide
gaacayagcttttctgggggagg

SEQ ID NO: 1334 - DNA, 23 bp, Artificial Sequence
  Description of Artificial Sequence: Synthetic oligonucleotide
tgactgyggggcgctccttatgg

SEQ ID NO: 1335 - DNA, 23 bp, Artificial Sequence
  Description of Artificial Sequence: Synthetic oligonucleotide
agtgtacytgacagcaatggtgg

SEQ ID NO: 1336 - DNA, 23 bp, Artificial Sequence
  Description of Artificial Sequence: Synthetic oligonucleotide
cgcycagcaggggtcagctcagg

SEQ ID NO: 1337 - DNA, 23 bp, Artificial Sequence
  Description of Artificial Sequence: Synthetic oligonucleotide
gatcayggccgagtagtcccggg

SEQ ID NO: 1338 - DNA, 23 bp, Artificial Sequence
  Description of Artificial Sequence: Synthetic oligonucleotide
tgatcayggccgagtagtcccgg

SEQ ID NO: 1339 - DNA, 23 bp, Artificial Sequence
  Description of Artificial Sequence: Synthetic oligonucleotide
agcccaygccgcccaggatctgg

SEQ ID NO: 1340 - DNA, 23 bp, Artificial Sequence
  Description of Artificial Sequence: Synthetic oligonucleotide
accgcggygaggacctctgtggg

SEQ ID NO: 1341 - DNA, 23 bp, Artificial Sequence
  Description of Artificial Sequence: Synthetic oligonucleotide
tgcyggcccatacctgtcaaggg

SEQ ID NO: 1342 - DNA, 23 bp, Artificial Sequence
  Description of Artificial Sequence: Synthetic oligonucleotide
ctgcyggcccatacctgtcaagg

SEQ ID NO: 1343 - DNA, 23 bp, Artificial Sequence
  Description of Artificial Sequence: Synthetic oligonucleotide
gagygcacatctttttcctaggg

SEQ ID NO: 1344 - DNA, 23 bp, Artificial Sequence
  Description of Artificial Sequence: Synthetic oligonucleotide
tgagygcacatctttttcctagg

SEQ ID NO: 1345 - DNA, 23 bp, Artificial Sequence
  Description of Artificial Sequence: Synthetic oligonucleotide
gctgcaytgtagttgtggtgagg

SEQ ID NO: 1346 - DNA, 23 bp, Artificial Sequence
  Description of Artificial Sequence: Synthetic oligonucleotide
cgtgcgcygtcccagtttgaagg

SEQ ID NO: 1347 - DNA, 23 bp, Artificial Sequence
  Description of Artificial Sequence: Synthetic oligonucleotide
atgcggtyccagcctctgctggg

SEQ ID NO: 1348 - DNA, 23 bp, Artificial Sequence
  Description of Artificial Sequence: Synthetic oligonucleotide
tagccatygattgctggagaagg

SEQ ID NO: 1349 - DNA, 23 bp, Artificial Sequence
  Description of Artificial Sequence: Synthetic oligonucleotide
tcayattcagctcctatagcagg

SEQ ID NO: 1350 - DNA, 23 bp, Artificial Sequence
  Description of Artificial Sequence: Synthetic oligonucleotide
tgagcagyaaggaaagttattgg

SEQ ID NO: 1351 - DNA, 23 bp, Artificial Sequence
  Description of Artificial Sequence: Synthetic oligonucleotide
acagtgyctgcacccagcgcagg

SEQ ID NO: 1352 - DNA, 23 bp, Artificial Sequence
  Description of Artificial Sequence: Synthetic oligonucleotide
gagycacatcttggggaagctgg

SEQ ID NO: 1353 - DNA, 23 bp, Artificial Sequence
  Description of Artificial Sequence: Synthetic oligonucleotide
tagcatayttgcaacaagcttgg

SEQ ID NO: 1354 - DNA, 23 bp, Artificial Sequence
  Description of Artificial Sequence: Synthetic oligonucleotide
aatcctgyacagcaggacttggg

SEQ ID NO: 1355 - DNA, 23 bp, Artificial Sequence
  Description of Artificial Sequence: Synthetic oligonucleotide
accaccgyagcaggcattggtgg

SEQ ID NO: 1356 - DNA, 23 bp, Artificial Sequence
  Description of Artificial Sequence: Synthetic oligonucleotide
gcatccyttccagtgtactccgg

SEQ ID NO: 1357 - DNA, 23 bp, Artificial Sequence
  Description of Artificial Sequence: Synthetic oligonucleotide
cctcayatccaggcaagaattgg

SEQ ID NO: 1358 - DNA, 23 bp, Artificial Sequence
  Description of Artificial Sequence: Synthetic oligonucleotide
tggccyaccagatcatgccttgg

SEQ ID NO: 1359 - DNA, 23 bp, Artificial Sequence
  Description of Artificial Sequence: Synthetic oligonucleotide
ccatayaccagcccaggtacagg

SEQ ID NO: 1360 - DNA, 23 bp, Artificial Sequence
  Description of Artificial Sequence: Synthetic oligonucleotide
cgagacaytggcaacagggaagg

SEQ ID NO: 1361 - DNA, 23 bp, Artificial Sequence
  Description of Artificial Sequence: Synthetic oligonucleotide
cttcycatactccttgatggtgg

SEQ ID NO: 1362 - DNA, 23 bp, Artificial Sequence
  Description of Artificial Sequence: Synthetic oligonucleotide
gctcttcycatactccttgatgg

SEQ ID NO: 1363 - DNA, 23 bp, Artificial Sequence
  Description of Artificial Sequence: Synthetic oligonucleotide
ggatcayccgcagaatctgcagg

SEQ ID NO: 1364 - DNA, 23 bp, Artificial Sequence
  Description of Artificial Sequence: Synthetic oligonucleotide
atayctctaattacatcaggtgg

SEQ ID NO: 1365 - DNA, 23 bp, Artificial Sequence
  Description of Artificial Sequence: Synthetic oligonucleotide
agaatayctctaattacatcagg

SEQ ID NO: 1366 - DNA, 23 bp, Artificial Sequence
  Description of Artificial Sequence: Synthetic oligonucleotide
atayactctcctccatcttctgg

SEQ ID NO: 1367 - DNA, 23 bp, Artificial Sequence
  Description of Artificial Sequence: Synthetic oligonucleotide
ttctcayagaaggcgatgacggg

SEQ ID NO: 1368 - DNA, 23 bp, Artificial Sequence
  Description of Artificial Sequence: Synthetic oligonucleotide
tttctcayagaaggcgatgacgg

SEQ ID NO: 1369 - DNA, 23 bp, Artificial Sequence
  Description of Artificial Sequence: Synthetic oligonucleotide
tcccayacctgttccccagaagg

SEQ ID NO: 1370 - DNA, 23 bp, Artificial Sequence
  Description of Artificial Sequence: Synthetic oligonucleotide
cagcyagaagacacagggagggg

SEQ ID NO: 1371 - DNA, 23 bp, Artificial Sequence
  Description of Artificial Sequence: Synthetic oligonucleotide
acagcyagaagacacagggaggg

SEQ ID NO: 1372 - DNA, 23 bp, Artificial Sequence
  Description of Artificial Sequence: Synthetic oligonucleotide
cacagcyagaagacacagggagg

SEQ ID NO: 1373 - DNA, 23 bp, Artificial Sequence
  Description of Artificial Sequence: Synthetic oligonucleotide
ctcttaycttgggaaaggagagg

SEQ ID NO: 1374 - DNA, 23 bp, Artificial Sequence
  Description of Artificial Sequence: Synthetic oligonucleotide
ccayatcaggggcctgatactgg

SEQ ID NO: 1375 - DNA, 23 bp, Artificial Sequence
  Description of Artificial Sequence: Synthetic oligonucleotide
ccccygggaagggaagaaagggg

SEQ ID NO: 1376 - DNA, 23 bp, Artificial Sequence
  Description of Artificial Sequence: Synthetic oligonucleotide
gccccygggaagggaagaaaggg

SEQ ID NO: 1377 - DNA, 23 bp, Artificial Sequence
  Description of Artificial Sequence: Synthetic oligonucleotide
agccccygggaagggaagaaagg

SEQ ID NO: 1378 - DNA, 23 bp, Artificial Sequence
  Description of Artificial Sequence: Synthetic oligonucleotide
tcaaatcycaccctctggccagg

SEQ ID NO: 1379 - DNA, 23 bp, Artificial Sequence
  Description of Artificial Sequence: Synthetic oligonucleotide
cttgycatcatcatcaaaggggg

SEQ ID NO: 1380 - DNA, 23 bp, Artificial Sequence
  Description of Artificial Sequence: Synthetic oligonucleotide
tcttgycatcatcatcaaagggg

SEQ ID NO: 1381 - DNA, 23 bp, Artificial Sequence
  Description of Artificial Sequence: Synthetic oligonucleotide
atcttgycatcatcatcaaaggg

SEQ ID NO: 1382 - DNA, 23 bp, Artificial Sequence
  Description of Artificial Sequence: Synthetic oligonucleotide
gatcttgycatcatcatcaaagg

SEQ ID NO: 1383 - DNA, 23 bp, Artificial Sequence
  Description of Artificial Sequence: Synthetic oligonucleotide
ccaccyggttttctcttgattgg

SEQ ID NO: 1384 - DNA, 23 bp, Artificial Sequence
  Description of Artificial Sequence: Synthetic oligonucleotide
tgtycttcagtggctgagctggg

SEQ ID NO: 1385 - DNA, 23 bp, Artificial Sequence
  Description of Artificial Sequence: Synthetic oligonucleotide
ctgtycttcagtggctgagctgg

SEQ ID NO: 1386 - DNA, 23 bp, Artificial Sequence
  Description of Artificial Sequence: Synthetic oligonucleotide
attcaagyagattacctgattgg

SEQ ID NO: 1387 - DNA, 23 bp, Artificial Sequence
  Description of Artificial Sequence: Synthetic oligonucleotide
tccgcaytgcaagaggcctgggg

SEQ ID NO: 1388 - DNA, 23 bp, Artificial Sequence
  Description of Artificial Sequence: Synthetic oligonucleotide
ttccgcaytgcaagaggcctggg

SEQ ID NO: 1389 - DNA, 23 bp, Artificial Sequence
  Description of Artificial Sequence: Synthetic oligonucleotide
tgccacayactctggcttcaggg

SEQ ID NO: 1390 - DNA, 23 bp, Artificial Sequence
  Description of Artificial Sequence: Synthetic oligonucleotide
ggataacytgtactgttgtaggg

SEQ ID NO: 1391 - DNA, 23 bp, Artificial Sequence
  Description of Artificial Sequence: Synthetic oligonucleotide
accytgacctcctgccagtaggg

SEQ ID NO: 1392 - DNA, 23 bp, Artificial Sequence
  Description of Artificial Sequence: Synthetic oligonucleotide
taccytgacctcctgccagtagg

SEQ ID NO: 1393 - DNA, 23 bp, Artificial Sequence
  Description of Artificial Sequence: Synthetic oligonucleotide
tagccaytgattgctggagaagg

SEQ ID NO: 1394 - DNA, 23 bp, Artificial Sequence
  Description of Artificial Sequence: Synthetic oligonucleotide
cagyacaacactgctgctgtggg

SEQ ID NO: 1395 - DNA, 23 bp, Artificial Sequence
  Description of Artificial Sequence: Synthetic oligonucleotide
gcagyacaacactgctgctgtgg

SEQ ID NO: 1396 - DNA, 23 bp, Artificial Sequence
  Description of Artificial Sequence: Synthetic oligonucleotide
gcccayggcggcggcggcggcgg

SEQ ID NO: 1397 - DNA, 23 bp, Artificial Sequence
  Description of Artificial Sequence: Synthetic oligonucleotide
cctcactygtggaaagaaacggg

SEQ ID NO: 1398 - DNA, 23 bp, Artificial Sequence
  Description of Artificial Sequence: Synthetic oligonucleotide
tcacayctttctcctcatcatgg

SEQ ID NO: 1399 - DNA, 23 bp, Artificial Sequence
  Description of Artificial Sequence: Synthetic oligonucleotide
cgctyggcgaagaaatctgcggg

SEQ ID NO: 1400 - DNA, 23 bp, Artificial Sequence
  Description of Artificial Sequence: Synthetic oligonucleotide
gcgctyggcgaagaaatctgcgg

SEQ ID NO: 1401 - DNA, 23 bp, Artificial Sequence
  Description of Artificial Sequence: Synthetic oligonucleotide
tccygtcaaaggaaaaacagagg

SEQ ID NO: 1402 - DNA, 23 bp, Artificial Sequence
  Description of Artificial Sequence: Synthetic oligonucleotide
tgtytctctgcaaaggggccagg

SEQ ID NO: 1403 - DNA, 23 bp, Artificial Sequence
  Description of Artificial Sequence: Synthetic oligonucleotide
tgtcayagtccaagctctgcagg

SEQ ID NO: 1404 - DNA, 53 bp, Homo sapiens
gatgatgccaaaatcaactttaatgaaaaactatctcaactgcagacatatat

SEQ ID NO: 1405 - DNA, 52 bp, Homo sapiens
gatacaatttgatcagtatattaaagatagttatgatttacatgatttgaaa

SEQ ID NO: 1406 - DNA, 23 bp, Artificial Sequence
  Description of Artificial Sequence: Synthetic oligonucleotide
gtcatcttagtcattacctgagg

SEQ ID NO: 1407 - DNA, 23 bp, Artificial Sequence
  Description of Artificial Sequence: Synthetic oligonucleotide
gagtccgagcagaagaagaaggg

SEQ ID NO: 1408 - DNA, 23 bp, Artificial Sequence
  Description of Artificial Sequence: Synthetic oligonucleotide
gtattcacctgaaagtgtgcagg

SEQ ID NO: 1409 - DNA, 22 bp, Artificial Sequence
  Description of Artificial Sequence: Synthetic oligonucleotide
gaatcccttctgcagcacctgg

SEQ ID NO: 1410 - DNA, 22 bp, Artificial Sequence
  Description of Artificial Sequence: Synthetic oligonucleotide
aacacaaagcatagactgcggg

SEQ ID NO: 1411 - DNA, 22 bp, Artificial Sequence
  Description of Artificial Sequence: Synthetic oligonucleotide
gcccagactgagcacgtgatgg

SEQ ID NO: 1412 - DNA, 21 bp, Artificial Sequence
  Description of Artificial Sequence: Synthetic oligonucleotide
ggcactgcggctggaggtggg

SEQ ID NO: 1413 - DNA, 22 bp, Artificial Sequence
  Description of Artificial Sequence: Synthetic oligonucleotide
cgtgacttccacatgagcgtgg

SEQ ID NO: 1414 - DNA, 23 bp, Artificial Sequence
  Description of Artificial Sequence: Synthetic oligonucleotide
gaccccctccaccccgcctccgg

SEQ ID NO: 1415 - DNA, 23 bp, Artificial Sequence
  Description of Artificial Sequence: Synthetic oligonucleotide
gactcacccaggagtgcgttagg

SEQ ID NO: 1416 - DNA, 23 bp, Artificial Sequence
  Description of Artificial Sequence: Synthetic oligonucleotide
ggcactcgggggcgagaggaggg

SEQ ID NO: 1417 - DNA, 23 bp, Artificial Sequence
  Description of Artificial Sequence: Synthetic oligonucleotide
gagctcactgaacgctggcatgg

SEQ ID NO: 1418 - protein, 47 aa, Homo sapiens
WEFDVFYDPRELRKEACLLYEIKWGMSRKIWRSSGKNTTNHVEVNFI

SEQ ID NO: 1419 - protein, 69 aa, Rattus norvegicus
MSSETGPVAVDPTLRRRIEPHEFEVFFDPRELRKETCLLYEINWGGRHSIWRHTSQNTNKHVEVNFIEK

SEQ ID NO: 1420 - protein, 69 aa, Mus musculus
MSSETGPVAVDPTLRRRIEPHEFEVFFDPRELRKETCLLYEINWGGRHSVWRHTSQNTSNHVEVNFLEK

SEQ ID NO: 1421 - protein, 47 aa, Rattus norvegicus
HEFEVFFDPRELRKETCLLYEINWGGRHSIWRHTSQNTNKHVEVNFI

SEQ ID NO: 1422 - protein, 61 aa, Tarsius syrichta
MGDPTLRRRIEPWEFEVLFDPRELRKEACLLYEIKWGTSCKIWRNSGKNTSNHAEVNFLEK

SEQ ID NO: 1423 - protein, 69 aa, Mesocricetus auratus
MSSETGPVVVDPTLRRRIEPHEFDAFFDQGELRKETCLLYEIRWGGRHNIWRHTGQNTSRHVEINFIEK

SEQ ID NO: 1424 - protein, 59 aa, Saimiri boliviensis
MTSERRRIEPWEFSISYDPRELCKETCLLYEIKWGMSWKIWRSSGKNTTNHVEVNFIEK

SEQ ID NO: 1425 - protein, 24 aa, Rhinopithecus roxellana
MSWKIWRSSGKNTTNHVEVNFIEK

SEQ ID NO: 1426 - protein, 24 aa, Chlorocebus sabaeus
MSRKIWRSSGKNTTNHVEVNFIEK

SEQ ID NO: 1427 - protein, 55 aa, Equus caballus
RRRIQPWEFEAFFDPRELRKEACLLYEIKWGMSHNIWRYSGKNTTKHVEINFIEK

SEQ ID NO: 1428 - protein, 69 aa, Neomonachus schauinslandi
MASDKGPSAGDATLRRRIKPWEFEVFFDPRELRKETCLLYEIQWGTSHKIWRNSGKNTANHVEINFIEK

SEQ ID NO: 1429 - protein, 69 aa, Odobenus rosmarus
MASDKGPSAGDATLRRRIEPWEFEVFFDPRELRKEACLLYEIQWGTSHKIWRNSGKNTSNHVEINFIEK

SEQ ID NO: 1430 - protein, 81 aa, Trichechus manatus
MTSEEADQRHSTMTSEKGPSTGDGTLRRRITPWEFEIFFDPRELRKETCLLYEIKWGTSHRIWRNSGQNTTKHAEVNFIEK

SEQ ID NO: 1431 - protein, 63 aa, Colobus angolensis
PSTGDPTLRRRIEPWEFDIFYDPRELRKEACLLYEIKWGMSQKIWRSSGKNTTNHVEVNFIEK

SEQ ID NO: 1432 - protein, 54 aa, Callithrix jacchus
RRIEPWEFYISYDPKELCKETCLLYEIKWGMSWKIWRSSGKNTTNHVEINFIEK

SEQ ID NO: 1433 - protein, 69 aa, Papio anubis
MTSEKGPSTGDPTLRRRIEPWEFDIFYDPRELRKEACLLYEIKWGMSPKIWRSSGKNTTNHVEVNFIEK

SEQ ID NO: 1434 - protein, 64 aa, Macaca fascicularis
GPSTGDPTLRRRIEPWEFDIFYDPRELRKEACLLYEIKWGMSPKIWRSSGKNTTNHVEVNFIEK

SEQ ID NO: 1435 - protein, 69 aa, Homo sapiens
MTSEKGPSTGDPTLRRRIEPWEFDVFYDPRELRKEACLLYEIKWGMSRKIWRSSGKNTTNHVEVNFIKK

SEQ ID NO: 1436 - protein, 69 aa, Nomascus leucogenys
MTSEKGPSTGDPTLRRRIEPWEFDVFYDPRELRKEACLLYEIKWGMSQKIWRSSGKNTTNHVEVNFIKK

SEQ ID NO: 1437 - protein, 69 aa, Macaca nemestrina; identical to SEQ ID NO: 1433

SEQ ID NO: 1438 - protein, 64 aa, Macaca mulatta; identical to SEQ ID NO: 1434

SEQ ID NO: 1439 - protein, 69 aa, Otolemur garnettii
ISWSTGISTGDPTLRRRIEPWEFEVFFDPRELRKETCLLYEIKWGTSHKIWRSTARNTTSHAEMNFIEK

SEQ ID NO: 1440 - protein, 69 aa, Cercocebus atys; identical to SEQ ID NO: 1433

SEQ ID NO: 1441 - protein, 69 aa, Pongo abelii
MTSEKGPSTGDPTLRRRIESWEFDVFYDPRELRKETCLLYEIKWGMSRKIWRSSGKNTTNHVEVNFIKK

SEQ ID NO: 1442 - protein, 69 aa, Aotus nancymaae
MTSERGPSTGDPTLRRRIEPWEFCISYDPKELCKETCLLYEIKWGTSWKIWRSSGKNTTNHVEVNFIEK

SEQ ID NO: 1443 - protein, 69 aa, Sus scrofa
MASDRGPSAGDATSRRRIEPWEFEVFFDPRELRKETCLLYELQWGRSRDTWRHTGKNTTNHVERNFLAK

SEQ ID NO: 1444 - protein, 56 aa, Loxodonta africana
FRRRIKPWEFEIFFDPRQLRKETCLLYEIKWGTSHKVWRNSGQNTTKHVEVNFIEK

SEQ ID NO: 1445 - protein, 69 aa, Canis lupus familiaris
MASDKGPSAGDATLRRRIEPWEFEGFFDPRELRKETCLLYEIQWGTSHKTWRNSGKNTTNHVEINFMEK

SEQ ID NO: 1446 - protein, 69 aa, Mandrillus leucophaeus; identical to SEQ ID NO: 1433

SEQ ID NO: 1447 - protein, 69 aa, Enhydra lutris
MASDKGPSAGDATLRRRIEPWEFEVFFDPRELRKEACLLYEIQWGTSHKMWRNTGKNTANHVELNFIEK

SEQ ID NO: 1448 - protein, 69 aa, Mustela furo; identical to SEQ ID NO: 1447

SEQ ID NO: 1449 - protein, 69 aa, Pteropus alecto
ISWSTGPSTGDPTLRRRIEPWEFEVFFDPRELRKEACLLYEIQWGTSHKIWRNSGKNTTKHVELNFIEK

SEQ ID NO: 1450 - protein, 69 aa, Felis catus
MASDKGPSAGDATLRRRIEPREFEVFFDPRELRKEACLLYEIKWGTSHRIWRNSGRNTANHVELNFIEK

SEQ ID NO: 1451 - protein, 69 aa, Pan troglodytes; identical to SEQ ID NO: 1435

SEQ ID NO: 1452 - protein, 59 aa, Propithecus coquereli
MTSEKRRIEPWEFEAFFDPRELRKEACLLYEIKWGASHKIWRNTGKSTTRHVEVNFIEK

SEQ ID NO: 1453 - protein, 69 aa, Physeter macrocephalus
ICWSTGPSAGDATSRRRIEPWEFEVSFDPREFCKEARLLYEIKWGKSQDVWRHSGKNTTKHVECNFIEK

SEQ ID NO: 1454 - protein, 55 aa, Corvus brachyrhynchos
RWKIEPGDFQINYSPSQHRRGVYLLYEIRWRRGSIWRNWCSNTHRQHAEVNFLEN

SEQ ID NO: 1455 - protein, 69 aa, Pongo pygmaeus; identical to SEQ ID NO: 1441

SEQ ID NO: 1456 - protein, 55 aa, Manacus vitellinus
RWKIQPKDFKRNYLPGQHPQVVYLLYEIRWRNGSIWRNWFSNNRNQHAEVNFLEN

SEQ ID NO: 1457 - protein, 69 aa, Bos mutus
ISWSTGPPAGDPTLRRRIEPWEFEFSFDPRKFCKEACLLYEIQWGNNRDVWRHSGKNTTKHVERNFIEK

SEQ ID NO: 1458 - protein, 69 aa, Rhinopithecus bieti
MTSEKGPSTGDPTLRRRIEPWEFDIFYDPRELRKEACLLYEIKWGMSWKIWRSSGKNTTNHVEVNFIEK

SEQ ID NO: 1459 - protein, 69 aa, Cebus capucinus
MTSERGPSTGDPTLRRRIEPWEFYISYDPKELCKETCLLYEIKWGMSWKIWRSSGKNTTNHVEVNFIEK

SEQ ID NO: 1460 - protein, 55 aa, Nestor notabilis
RWKIQPNDFKRNYLPYQHPKVVCLLYEIRWNRGTIWRSWCSNNSTQHAEVNFLEN

SEQ ID NO: 1461 - protein, 55 aa, Eurypyga helias
RWKIQPNDFKRNYMPSQYPKVVYLLYEIRWSRGTVWRNWCSNSFTQHAEVNFLEN

SEQ ID NO: 1462 - protein, 55 aa, Aptenodytes forsteri
RWKIRPNDFKRNYLPGQHPKVVYLLYEIRWSRGTIWRNWCSNNSTQHAEVNFLEN

SEQ ID NO: 1463 - protein, 55 aa, Egretta garzetta
RWKIQPNDFKRNYLPGQHPKVVYLLYEIRWSRGTIWRNWCSNNSTQHAEVNFLEN

SEQ ID NO: 1464 - protein, 55 aa, Gavia stellata
RWKIQPNDFKRNYLPAQHPKVVYLLYEIRWSRGTIWRNWCSNNSTQHAEVNFLEN

SEQ ID NO: 1465 - protein, 55 aa, Acanthisitta chloris
RWKIQPNDFQRNYLPDQHPQAVYLLYEFRWRRGSIWRKWCSNNRAQHAEVNFLEN

SEQ ID NO: 1466 - protein, 55 aa, Haliaeetus albicilla
RWKLQPNDFKRNYLPGQHPKVVYLLYEIRWSRGTIWRNWCSNNSTQHAEVNFLEN

SEQ ID NO: 1467 - protein, 55 aa, Antrostomus carolinensis
RWKMQPNDFKRNYLPVQYPNMVYLLYEIRWSTGTIWRNWCSNNSTQHAEVNFLEN

SEQ ID NO: 1468 - protein, 55 aa, Nipponia nippon
RWKIQPNDFRSNYLPCQHPRVVYLLYEIRWSRGTIWRNWCSNNSTQHAEVNFLEN

SEQ ID NO: 1469 - protein, 55 aa, Pelecanus crispus
RWKLQPEDFKRNYLPGQHPKVVYLLYEIRWSRGTIWRSWCSNNSKQHAEVNFLEN

SEQ ID NO: 1470 - protein, 55 aa, Balearica regulorum
RWKIQPDDFKRNYLPGKHPRVVYLLYEIRWSRGTIWRSWCSNNATQHAEINFLET

SEQ ID NO: 1471 - protein, 55 aa, Merops nubicus
RWKIEPDEFKTNYSPDHRPRVVYLLYEIRWRRGTIWRNWCSNNIDQHAEVNFLEN

SEQ ID NO: 1472 - protein, 55 aa, Fulmarus glacialis
RWKIQPNDFKRNFLPSKYPKVVYLLYEIRWSSGTIWRSWCSNNSTQHAEVNFLEN

SEQ ID NO: 1473 - protein, 69 aa, Bos taurus
MASDRGPPAGDPTLRRRIEPWEFEFSFDPRKFCKEACLLYEIQWGNNRDVWRHSGKNTTKHVERNFIEK

SEQ ID NO: 1474 - protein, 55 aa, Dryobates pubescens
RWKIHPDEFKLNYVPVGRPRVVYLLYEIRWSRGSIWRNWCSNSSTQHAEVNFLEN

SEQ ID NO: 1475 - protein, 69 aa, Ailuropoda melanoleuca
ISWSTGPSGGDATSRRRIEPWEFEVFFDPRQLRKEACLLYEIQWGTSRKIWRNSGKNTTNHVEINFIEK

SEQ ID NO: 1476 - protein, 55 aa, Calypte anna
RWKIQPNDFKRNYQPGRRPNVVYLLYEIRWRRGTIWRNWCSNEFPQHAEDNFFQN

SEQ ID NO: 1477 - protein, 69 aa, Oryctolagus cuniculus
MASEKGPSNKDYTLRRRIEPWEFEVFFDPQELRKEACLLYEIKWGASSKTWRSSGKNTTNHVEVNFLEK

SEQ ID NO: 1478 - protein, 55 aa, Cariama cristata
RWKIQPDDFKRNYLPGQHPEVVYLLYEIKWNSGTIWRNWCSNNPTQHAEVNFLEN

SEQ ID NO: 1479 - protein, 69 aa, Ovis aries
MASDRGPPAGDPTLRRRIEPLEFEFSFDPRNFCKEAYLLYEIQWGNSRDVWRHSGKNTTKHVERNFIEK

SEQ ID NO: 1480 - protein, 69 aa, Tursiops truncatus
ICWSTGPSAGDATLRRRIEPWEFEVSFDPRELSKETRLLYEIKWGKSQRIWRHSGKNTTKHVERNFIEQ

SEQ ID NO: 1481 - protein, 55 aa, Opisthocomus hoazin
RWKVQPNDFKRNYLPGQHPKVVYILYEIRWSRGTIWRNWCTNNSTQHAEVNFLEN

SEQ ID NO: 1482 - protein, 69 aa, Myotis davidii
PVSFIVLKSVETLCVRRIEPWEFEAIFDPRELRKEACLLYEIKWGTGHKIWRHSGKNTTRHVEVNFIEK

SEQ ID NO: 1483 - protein, 61 aa, Sarcophilus harrisii
MGDATLRRRIKSWEFEAFFNPQELRKETCLLYEIKWGASHNIWRSSNQNTTQHAEINFMEK

SEQ ID NO: 1484 - protein, 55 aa, Pterocles gutturalis
RWKIQPNYFKINNLPGQHPRVVCLLYAIRWSRSTLWKSWCSNNSTQHAEVNFLEN

SEQ ID NO: 1485 - protein, 69 aa, Delphinapterus leucas
ICWSTGPSAGDATSRRRIEPWEFEVSFDPRELCKETRLLYEIKWGKSQHVWRHSDKNTTKHVECKFIEK

SEQ ID NO: 1486 - protein, 53 aa, Pan paniscus
ISWSTGPSTGDPTLRRRIEPWEFDVFYDPRELRKEACLLYEIKWGMSRKIWRS

SEQ ID NO: 1487 - protein, 68 aa, Monodelphis domestica
MNSKTGPSVGDATLRRRIKPWEFVAFFNPQELRKETCLLYEIKWGNQNIWRHSNQNTSQHAEINFMEK

SEQ ID NO: 1488 - protein, 54 aa, Erinaceus europaeus
RRIEPWEFEDFFDPRQFRPETCLLYEVRWGSSRNAWRSTARNTTRHAEVNFLER

SEQ ID NO: 1489 - protein, 55 aa, Heterocephalus glaber
RRRIEPWQFEASFDPRQLRRETCLLSEVRWGTSPRAWRGCSLNTARHAEVSFMDR

SEQ ID NO: 1490 - protein, 69 aa, Leptonychotes weddellii; identical to SEQ ID NO: 1428

SEQ ID NO: 1491 - protein, 55 aa, Tyto alba
RWKIQPNDFKRNFLPGQHPKVVYLMYEIRWIRGTAWRSWCSNNSKQDAEVNLLEN

SEQ ID NO: 1492 - protein, 69 aa, Cavia porcellus
MASGTGPSTGDATLRRRIEPWQFEAYFDPRQLRKEACMLSEVRWGASPRTWRESSLNTTSHVEINFIEK

SEQ ID NO: 1493 - protein, 69 aa, Dipodomys ordii
LPPTEAPATGDDTLRRRIEPWEFEAFFNPQELRREACLLYQITWSSHKVWRETAKNTVDSHVEVNFIQN

SEQ ID NO: 1494 - protein, 65 aa, Anolis carolinensis
KAAILLSNLFFRWQMEPEAFQRNFDPREFPECTLLLYEIHWDNNTSRNWCTNKPGLHAEENFLQI

SEQ ID NO: 1495 - protein, 70 aa, Alligator mississippiensis
MAVEEEKGLLGTSQGWKIELKDFQENYMPSTWPKVTHLLYEIRWGKGSKVWRNWCSNTLTQHAEVNCLEN

SEQ ID NO: 1496 - protein, 65 aa, Lonchura domestica
MYRRKMRGMYISKRALRKHFDPRNYPRETYLLCELQWRGSHKSWQHWLRNDDSKDCHAEKYFLEE

SEQ ID NO: 1497 - protein, 69 aa, Columba livia
AVTNRDSACRENNQRWKIQPNDFRRNYLPDKQPRVVYLLYEIRWRRGTIWRNWCSNNPNQHAEVNFLKN

SEQ ID NO: 1498 - protein, 64 aa, Alligator sinensis
MGEHWQYAGSGEYIPQDQFEENFDPSVLLAETHLLSELTWGGRPYKHWYENTEHCHAEIHFLEN

SEQ ID NO: 1499 - protein, 65 aa, Protopterus annectens
MVQKRTSASKTRMTKKVLLSEYQKFYYSPRTCIGYVIQYDEDNVIFQNWICNKRTTHAELQCIYE

SEQ ID NO: 1500 - protein, 62 aa, Patagioenas fasciata
MRRKKPSGMYISKRALKDNFDPHKFPHDTYLLCKLQWGDTGRSWIHWIRKDRYHAEVYFLEK

SEQ ID NO: 1501 - protein, 69 aa, Amazona aestiva
  MOD_RES (33)..(33): Any amino acid
EYVDTSVSEDTTICGMYIPKEALKYHFDPREVXRDTYLLCILRWGETGTPWSHWVKNYRYHAEVYFLEK

SEQ ID NO: 1502 - protein, 65 aa, Stylophora pistillata
MASVTELRTPDDFLAELLWTGVTGRTWPNRTFLIVSIKAKDGKPIFGKRFKNRYPEHAEIIMLRN

SEQ ID NO: 1503 - protein, 45 aa, Rattus norvegicus
SPSNEAHWPRYPHLWVRLYVLELYCIILGLPPCLNILRRKQPQLT

SEQ ID NO: 1504 - protein, 45 aa, Mus musculus
PPSNEAYWPRYPHLWVKLYVLELYCIILGLPPCLKILRRKQPQLT

SEQ ID NO: 1505 - protein, 45 aa, Cricetulus griseus
PPSNEVYWPRYPNVWMRMYALELYCIVLGLPPCLKIIRRHQHPLT

SEQ ID NO: 1506 - protein, 45 aa, Fukomys damarensis
PPGQEARWPRFPPVWTMLYTLELCCVLLNLPPCLKISRRCHNQLA

SEQ ID NO: 1507 - protein, 45 aa, Myotis brandtii
PPGKDTHCPMYPPLWMKLYALELHCIILSLPPCLMISRRCQKQLT

SEQ ID NO: 1508 - protein, 45 aa, Mesocricetus auratus
PPSNEVYWPRYPNLWMRLYALELYCIHLGLPPCLKIKRRHQYPLT

SEQ ID NO: 1509 - protein, 28 aa, Saimiri boliviensis
PPGEEAHWPRHPPLWMMLYALELHCIIL

SEQ ID NO: 1510 - protein, 45 aa, Rhinopithecus roxellana
PPGEEAHWPRYPPLWMMLYALELHCIILSLPPCLKISRRWQNHLT

SEQ ID NO: 1511 - protein, 45 aa, Chlorocebus sabaeus; identical to SEQ ID NO: 1510

SEQ ID NO: 1512 - protein, 45 aa, Equus caballus
PPGKEAHWPRYSLLWMKLYALELHCIILSLPPCLMISRRCQNQLT

SEQ ID NO: 1513 - protein, 44 aa, Neomonachus schauinslandi
LPGKEDHWPRYPVLWMKLYALELHCIILSLPPCLRISRRQNQLT

SEQ ID NO: 1514 - protein, 44 aa, Odobenus rosmarus
PPGKEDHWPRYPVLWMKLYALELHCIILSLPPCLRISRRQNQLT

SEQ ID NO: 1515 - protein, 45 aa, Trichechus manatus
PPGEEARWPRYPPLWMMLYALELHCIILGLPPCLKISRRRQSQLT

SEQ ID NO: 1516 - protein, 45 aa, Colobus angolensis; identical to SEQ ID NO: 1510

SEQ ID NO: 1517 - protein, 45 aa, Callithrix jacchus
PPGEEAHWPRHPPLWLMLYALELHCIILGLPPCLKISRRRQNRLT

SEQ ID NO: 1518 - protein, 45 aa, Papio anubis; identical to SEQ ID NO: 1510

SEQ ID NO: 1519 - protein, 45 aa, Macaca fascicularis; identical to SEQ ID NO: 1510

SEQ ID NO: 1520 - protein, 45 aa, Homo sapiens
PPGDEAHWPQYPPLWMMLYALELHCIILSLPPCLKISRRWQNHLT

SEQ ID NO: 1521 - protein, 45 aa, Nomascus leucogenys
PPGDEAHWPRYPPLWMMLYALELHCIILSLPPCLKISRRWQNHLT

SEQ ID NO: 1522 - protein, 45 aa, Macaca nemestrina
LPGEEAHWPRYPPLWMMLYALELHCIILSLPPCLKISRRWQNHLT

SEQ ID NO: 1523 - protein, 45 aa, Macaca mulatta; identical to SEQ ID NO: 1510

SEQ ID NO: 1524 - protein, 45 aa, Otolemur garnettii
LPGKEAHCPRCPPLWMTLYALELHCIILSLPPCLKISRGHQNQLT

SEQ ID NO: 1525 - protein, 45 aa, Cercocebus atys
PPGEEAHWPRYPPLWMMLYALELHCIILSLPPCLKISRRQQNHLT

SEQ ID NO: 1526 - protein, 45 aa, Pongo abelii
PPGDEAHWPQYPPLWMMLYALELHCIILSLPPCLKISRRWQNHLA

SEQ ID NO: 1527 - protein, 45 aa, Aotus nancymaae
PPGEEAHWPRYPPLWMMLYALELHCIILGLPPCLKISRRWQNRLT

SEQ ID NO: 1528 - protein, 45 aa, Sus scrofa
PPGKEAHWPRFPPVWMTLYALELHCIILGLPPCLKISRRCQNQLT

SEQ ID NO: 1529 - protein, 45 aa, Loxodonta africana
SPGEETYWPRYPPLWMMMYALELHCIILSLPPCLKISRRCQHQLT

SEQ ID NO: 1530 - protein, 45 aa, Canis lupus familiaris
PPGKEDHWPRYPVLWMKLYALELHCIILNLPPCLKISRRNQHQLT

SEQ ID NO: 1531 - protein, 45 aa, Mandrillus leucophaeus; identical to SEQ ID NO: 1525

SEQ ID NO: 1532 - protein, 45 aa, Enhydra lutris
PPGKEDHWPRYPELWMKLYELELYCIILSLPPCLKISRRNQNQLT

SEQ ID NO: 1533 - protein, 45 aa, Mustela furo
PPGKEDHWPRYPELWMKLYELELYCIILSLPPCLKISRRNQKQLT

SEQ ID NO: 1534 - protein, 45 aa, Pteropus alecto
PPGKEAHWPRYPPLWMKLYALELHCIILSLPPCVMISRRCQKQLT

SEQ ID NO: 1535 - protein, 45 aa, Felis catus
PPGEEDHWPRYPVVWMKLYALELHCIILSLPPCLKILRRCQNQLT

SEQ ID NO: 1536 - protein, 45 aa, Pan troglodytes; identical to SEQ ID NO: 1520

SEQ ID NO: 1537 - protein, 45 aa, Propithecus coquereli
PPGKEASCPTYPPLWMTLYALELHCIILSLPPCLKISRRCQNQLT

SEQ ID NO: 1538 - protein, 45 aa, Physeter macrocephalus
PPGKEAHWPRYPPLWMKLYALELHCIILGLPPCLKISRRCQNQLT

SEQ ID NO: 1539 - protein, 45 aa, Pongo pygmaeus; identical to SEQ ID NO: 1526

SEQ ID NO: 1540 - protein, 45 aa, Bos mutus
PRGKEAHWPRYPPLWMNLYALELYCIILGLPPCLHISRRYQNQLI

SEQ ID NO: 1541 - protein, 45 aa, Rhinopithecus bieti; identical to SEQ ID NO: 1510

SEQ ID NO: 1542 - protein, 45 aa, Cebus capucinus
PPGEEAHWPRHPPLWMMLYALELHCIILGLPPCLKISRRRQNRLT

SEQ ID NO: 1543 - protein, 45 aa, Bos taurus; identical to SEQ ID NO: 1540

SEQ ID NO: 1544 - protein, 45 aa, Ailuropoda melanoleuca
YPPGKDHWPGYPVLWMKLYALELHCIILSLPPCLKISRRNQNQLT

SEQ ID NO: 1545 - protein, 45 aa, Oryctolagus cuniculus
PPGKAAQWPRYPPRWMLMYALELYCIILGLPPCLKISRRHQKQLT

SEQ ID NO: 1546 - protein, 45 aa, Ovis aries
PQGKEAHWPRYPPLWMNLYALELYCIISGLPPCLQISRRHQNQLR

SEQ ID NO: 1547 - protein, 44 aa, Tursiops truncatus
APGKEAHWPRYPPLLMKLYALELHCIILGLPPCLNISRYQNQLT

SEQ ID NO: 1548 - protein, 45 aa, Myotis davidii
PPGKDTHCPIYPPLLMKLYALELHCIILSLPPCLMISRRCQKQLT

SEQ ID NO: 1549 - protein, 45 aa, Sarcophilus harrisii
LPEEEDHWPKYPTLWIMLYVLELHCIILGLPPCLKISVRHSDQLV

SEQ ID NO: 1550 - protein, 44 aa, Delphinapterus leucas
PPGKEAHWPRYPPMLMKLYALELHCIILGLPPCLNISRYQNQLT

SEQ ID NO: 1551 - protein, 45 aa, Pan paniscus; identical to SEQ ID NO: 1520

SEQ ID NO: 1552 - protein, 45 aa, Monodelphis domestica
PQGEEDYWPKYPYLWIMLYVLELHCIILGLPPCLKISGSHSNQLA

SEQ ID NO: 1553 - protein, 45 aa, Erinaceus europaeus
PPGAEGHYPRYPSDFTRLYALELHCIILGLPPCLEILRRYQNQFT

SEQ ID NO: 1554 - protein, 45 aa, Heterocephalus glaber
SPGQEARWPQVPPVWTWLYSLELHCILLNLPPCLKISRRHHNQLT

SEQ ID NO: 1555 - protein, 43 aa, Leptonychotes weddellii
PGKEDHWPRYPVLWMKLYALELHCIILPIEMPGKIRDAPNNME

SEQ ID NO: 1556 - protein, 45 aa, Cavia porcellus
PPGQEAGWPRFPPMWTTLYALELSCILLSLPPCLKISRRRQYRLI

SEQ ID NO: 1557 - protein, 45 aa, Dipodomys ordii
PPGQEEHWPRYPVQCMTLYNLELYCIIHNLPPCVRISKQRQSQLA

SEQ ID NO: 1558 - protein, 30 aa, Anolis carolinensis
PRGANEDYWPQDFLPAITNYSRELDSILQD

SEQ ID NO: 1559 - protein, 38 aa, Alligator mississippiensis
PHEGEGDFWPWFFPLWITFYTLELQHILLQQHALSYNL

SEQ ID NO: 1560 - protein, 33 aa, Lonchura domestica
QPGVYYRFSPENFESAIRRNCSQLEDILQGLHL

SEQ ID NO: 1561 - protein, 40 aa, Columba livia
RQHGEEDYLPWSFALHIFLNCIEFQQILLGLPPLLPNFKY

SEQ ID NO: 1562 - protein, 63 aa, Alligator sinensis
EDESDDYGGYAGVHEDEDESDDDDYLPTHFAPWIMLYSLELSCILQGFAPCLKIIQGNHMSPT

SEQ ID NO: 1563 - protein, 44 aa, Protopterus annectens
TGEEIKKYEFFEKSSDHKSVNWRWTLKKILKEKDRDSDLENALS

SEQ ID NO: 1564 - protein, 47 aa, Patagioenas fasciata
GDADDDSWTVDFQSAITKNRLKLKDVFEFLKSHPNVTLEIYAAKLFK

SEQ ID NO: 1565 - protein, 43 aa, Amazona aestiva
ADGDSWIDDLKSEIRKNRLKFQGIFKDLPHQTEDVDFWLILAA

SEQ ID NO: 1566 - protein, 41 aa, Stylophora pistillata
TPEDKEKINKRDKDTANDLNEVLSSKQDQDASVDELSSQLN

SEQ ID NO: 1567 - protein, 42 aa, Homo sapiens
NETWLCFTVEGIKRRSVVSWKTGVFRNQVDSETHCHAERCFL

SEQ ID NO: 1568 - protein, 42 aa, Homo sapiens
NESWLCFTMEVVKHHSPVSWKRGVFRNQVDPETHCHAERCFL

SEQ ID NO: 1569 - protein, 42 aa, Homo sapiens
NESWLCFTMEVTKHHSAVFRKRGVFRNQVDPETHCHAERCFL

SEQ ID NO: 1570 - protein, 48 aa, Homo sapiens
HETYLCYEVERMHNDTWVLLNQRRGFLCNQAPHKHGFLEGRHAELCFL

SEQ ID NO: 1571 - protein, 48 aa, Homo sapiens
RQTYLCYEVERLDNGTWVLMDQHMGFLCNEAKNLLCGFYGRHAELRFL

SEQ ID NO: 1572 - protein, 48 aa, Homo sapiens
HKTYLCYEVERLDNGTSVKMDQHRGFLHNQAKNLLCGFYGRHAELRFL

SEQ ID NO: 1573 - protein, 39 aa, Homo sapiens
NKTFLCYVVEAQGKGGQVQASRGYLEDEHAAAHAEEAFF

SEQ ID NO: 1574 - protein, 38 aa, Homo sapiens
RETYLCYVVKRRDSATSFSLDFGYLRNKNGCHVELLFL

SEQ ID NO: 1575 - protein, 35 aa, Homo sapiens
RKALLCYQLTPQNGSTPTRGYFENKKKCHAEICFI

SEQ ID NO: 1576 - protein, 38 aa, Rattus norvegicus
AHWPRYPHLWVRLYVLELYCIILGLPPCLNILRRKQPQ

SEQ ID NO: 1577 - protein, 38 aa, Homo sapiens
AHWPQYPPLWMMLYALELHCIILSLPPCLKISRRWQNH

SEQ ID NO: 1578 - protein, 25 aa, Homo sapiens
EPFKPWKGLKTNFRLLKRRLRESLQ

SEQ ID NO: 1579 - protein, 25 aa, Homo sapiens
EPFKPWKGLKYNFLFLDSKLQEILE

SEQ ID NO: 1580 - protein, 25 aa, Homo sapiens
EPFKPWKGLQTNFRLLKRRLREILQ

SEQ ID NO: 1581 - protein, 29 aa, Homo sapiens
CPFQPWDGLDEHSQDLSGRLRAILQNQEN

SEQ ID NO: 1582 - protein, 29 aa, Homo sapiens
CPFQPWDGLEEHSQALSGRLRAILQNQGN

SEQ ID NO: 1583 - protein, 29 aa, Homo sapiens
CPFQPWDGLDEHSQALSGRLRAILQNQGN

SEQ ID NO: 1584 - protein, 25 aa, Homo sapiens
KAFQPWEDIQENFLYYEEKLADILK

SEQ ID NO: 1585 - protein, 40 aa, Homo sapiens
RTFKAWEGLHENSVRLSRQLRRILLPLYEVDDLRDAFRTL

SEQ ID NO: 1586 - protein, 40 aa, Homo sapiens
NPYKMLEELDKNSRAIKRRLERIKIPGVRAQGRYMDILCD

What is claimed is:

1. A method of deaminating a selected cytidine in a genomic DNA, the method comprising contacting the genomic DNA with a cytosine base editor comprising rat apolipoprotein B mRNA editing enzyme, catalytic polypeptide-like 1 (rAPOBEC1) of SEQ ID NO:67, bearing one or more mutations that decrease RNA editing activity while preserving DNA editing activity, wherein the mutations are R33A, K34A, or R33A+K34A (double mutant), relative to SEQ ID NO:67, and a programmable DNA binding domain.

2. The method of claim 1, wherein the genomic DNA is in a living cell.

3. The method of claim 2, wherein the living cell is in a mammal.

4. The method of claim 3, wherein the mammal is a human.

5. The method of claim 1, wherein the cytosine base editor further comprises a mutation at i) P29F or P29T, and/or ii) E181Q.

6. The method of claim 1, wherein the cytosine base editor comprises a linker between the rAPOBEC1 and the programmable DNA binding domain.

7. The method of claim 1, wherein the programmable DNA binding domain is selected from the group consisting of engineered Cys2-His2 (C2H2) zinc-fingers, transcription activator effector-like effectors (TALEs), and Clustered Regularly Interspaced Short Palindromic Repeats (CRISPR) Cas RNA-guided nucleases (RGNs).

8. The method of claim 7, wherein the CRISPR RGN is a Cas9 or Cas12a that is catalytically inactive or has ssDNA nickase activity.

9. The method of claim 1, further comprising at least one guide RNA compatible with the base editor that directs the base editor to a target sequence.

10. The method of claim 1, further comprising a uracil glycosylase inhibitor (UGI).

* * * * *